United States Patent 12,790,634 (MOST PROBABLE NUMBER ANALYSIS OF HETEROGENOUS POPULATIONS) - sequence listing, part 4

SEQ ID NO: 3 - DNA, 4880186 bp, Flavonifractor plautii (residues 1,626,730-3,253,458 of 4,880,186)
  source 1..4880186: mol_type = genomic DNA
tggtggacagcgaccagctataggccagacacacaggggcggcgaaccgcatacgcggttcgccgccccctttttgttccgttcatgtctcctggagcatccaaattgggaacagcacgccgtatactgtatccagggagtcgcggccggcctcaatggtgccgcccggcccgtccagaacggtcacggtgcagaccgtctcggacagatactccgcctcggccagcttctcccggaagagggccagcgcatcctccgcccaggccgcgtcataggccgcatatccctcgtctgtggacgtatccccggtgtagcccgcgttgaacgcgtccagccgctcccagagtgcatcgtttacccgcgccagcgcatccacgggccgcaccgttatctccacctcggaaccgtttcccgtcgggacggcggcccccacggtatagtccgccttggcgtacagctccttcagcaggccggccgcctctccgcggatctcctcggtggggaattcaattatcagcaggttgcagagcgcctgtacgttctcctccgcaatttgggcggacaggctctcctccgtctcccccagggcggtcagaaactccgggtcatacccacgccccagtcgggcatccagcaggcactggacatagcgggccgcgccgaaatcggcgggcacgcccggctccacctggccggagagcacctcgaggcgctctaccgtctcccccgccggaggcgtggtgacgggctgcgcagcggtttccgtgaccctcccgttcaggcttagctccaccttcccgatgtaagccccagtgaactccatctccagctccagacgccccggagcggcatccagggtaaagccggcgtcggctgggatgcccagcacatccagctccatctgtccgctgccgtccagcttctccagcgcaccgccccgcaggaccgcctccccatgcatgtccagagcaggcagcccctccacagcgggcgcgtcctccataacacccagcatacgggcccgctccagcagggcgggcagatccaccgcccagcgataggtggtccgtccaccggaggcgctgcgggtgaagttgccgtcgtccaggagcaggcggacgggcagggcggagtccatcaccgtctcccaggggctggagcggtagtaataccagctatggccgtacgcctccaccagcagctcgcccagcgtcccggggagcgacagggtgttcacggcaggcagctcccccacctgagtactcacccaaacgtcatcaggtaacggctctccctccaggctatagagctgtacgcccttttggtagagggtgccgctctcccggtcgtagagggtgacgctgtggttttcgagctgggccagctcctccggggagagacccgcaaagagggtgtcccccagaccgcccagatccacctgctgctcctgctccatgcggtagctgccgtcccgggtgagctgtttcacttccatcgtcagcgaggcggtgtcgtgctcctcctccccgtacagggtggcggagaggcgcatggatgctgtggactcatagcccttgcccgcctcgcggggaatggtatcccgtatcgcagcccaaatcccgttggcggcggtaaaccggctgtccagctccgccgtcagggcggcgtagtcggtcagatgggccgcctcataggtatcgtcccagtatacgtccagccccagtgcctccgccgcggcccggacggggatgtaggtgtgcccatcccgtacaaagggggccgcccccatgtccaaggtggtgatccgcccgccctgggtgacagtcagctcagtggcccccaggaccagctccaggctgtcgccgttctccagcgccgccgcgatgcggctcccgtcaaaggcaacctccgcccccagcccctccagaaaggcccggaagggcaccatggtgcaccccgacgcggccaggggggccgtgccgccgaagtccagatacgccccgttcaggctcacattgatgccgtcggggtagggcattcccatttcctccttctccacccggaggtactcgtcccaggggtccccgaaacgggcatagctccaccgatcgtagtcctcgttgtaccggttcagcgccgcccacatctgggcgtcgtactccgtccagtagttgtcccactggccgtccgtccaggtctcctccgccgcgtccttctgctcctggggccactcgccccaggggccatactgctggtacaggctgagttcggcgtccccctccgccgccagcgccggggtaaggcagcccaacagcaaaagggccgccagggacagggcaagtctccgtttcatgggtacagcctcctgtctatttcgttttccaaactcatcgtatcacttttctttacccttgtccatcctcctgcccattttttgcaaaaaagtgcccctctgcggtgcaggggggcacttttttccatacttattccagctcaacccggatatcgccaaacagaacgtgatccacccgttccagggggacgggcgcgtcaaagtaggtggtgccctccataaaggtcccgcccgccgtgccgctgccgccatccacagggatttccgtcccgtcggccagcaccaggcggatcccggtgtcggccagggtggcgctctccggggtgtcatagtgcatgcggtaggtgaggctgagggaggagaaggacagcttttccagcaccagtgtgttctggtgcgtctcatcgtaccacaccgccccggcggtgtccgcttccaccaccgctctgggttcgccgagaatctccagacggcagccgccgtactggaggtgatccagctcacgcaaatccaggggcgcgtcaaaattgcggacgccggtaaaatagtcggttccgccctgtccgtcggggccgtgactgcccttcccaccgccgccgtcaatcgtcacggaggacccgtccttgtagaccagttccagttggagatcgacaaactcccagctttcctccaccgggtaggagatggtataggaggccgccaggggggagcgcgtcagtccctccagggtgaccatccgctccgtctcctcatcccatcggacggcccctatggtgttgatctctacctcctttccctggtagaaggagtccagggagaagctccactccccctccagatacgtcttctcggcatcctccggctcccgggggcagagaatcaggtcggtgatggtcaatgtcttcgaggtgccgtccacccagttggccccgtttggcccgcccagaagcatgaacaccagctccagggagttgtcccccggggtgtcgtccgggaggaaccgggccttctgcatgccccagttgagccgctccccggtgtccgcgtcgaccagccccacaccgtgggcgatgtgatcctcctgctcccccatgtcgggcaggacggtgccctccggggcctccagccgcaggcggaggtagagggtgtgctcgtcggcaatggcggccagaggggtgagggtgacgccgttgctggtgacggggggcaggttggtggcgccgatctgatccagcagctccttctgcccgtcgtccagcggggcgctctccagggtgaagaaggggtcgaacagctctcccggcccccagaggtgataggccgccatggccgatacggtgaacaccgccgccagggcggcgcaggccagcagccggacgcccatgcgccggcggggccgcttggtttgtctgatttgttccatcgttctctccttgatccgctccggggacatcccggcgggcggcggcagctccaccgagccgtcctcccagccgtccagcaggtcagtcatccgcacaggcacaggaataccccctttccatcagcagctccttcagcttcctccgcccccggtgcaggcgcaccttcaccgtggacggcggcatggccagggccgctccgatgtcggcggcggtctggccgtagtagtaatggcgcaggaagatggcccgatcctggggcggaagtccgttcagcagcgcccggatcagctccgcccgctcggcctgctccacggcctccgccgggccgggccgccggtcgggctccagcgccagccagtcctcctccagaggcagctcaccgcccagcgcccgcaggcggttgagggccttgttgcgcaccacccggcccagccaggggcggagcttgcccggttccacctgcccggcgtgctcccacagggccaggaaggcgtcggacaccacctcctccgcgtccctggggcggccccgcagaacagagcccgccaggccgcaggcaaagcccatgtcccggtccatcagctcctccagggcggaggggtccccccgccgcaggcggcgcagcagctcccgctcctccaaccataccacctccctgctccggtttcgagcgcgctctcactgatcttaacacagaaaccgcccccgcggtttcacagactgtcaaagaacctttcccggaggaaagcctcgcagagttcctgcggccgcagccgcaggaatcaaatgaaaatccgtcatttccggggacatgcgcctcggaaatgacaccgctcgcgcaagatgggccgacttttccctgaggaatcgaggtccatcttgcgcacatccctctcaaaaaagtggccgtggccacttttttgacacgctgagaaaccgccccttcggtttcatcccttcccctcctttttcccggcgcgccgcgttccgaccacatttttccaaatactgggttatactgtcactcaacgagggcggacaagcctgatttggaaaaggagacggaaccatggcgacaaaagagaaactcaagacaaaggcggcccgtgtccgggaggaggcccgggagaccggcaaggtcattctgcgcgcccccgccctggtgcgggcggccgagtgcgtcatccgcttcctgctgggggccatgctctccggggcggagattttcggcggatacgcccccttcgggctggggctggtggcggcctccggctcggggctggacggcttctgcgccctgctgggggcctgcttcggctatctctccttccagggcttcgccgaggggctgcggtacgtggccggctgcatcctggccttctccctggcctttgccttcttcgacgtgaaggcttaccgcaagagctggttcatgcccctggcggcggcggggatggacggcatcacgggctttgtgtacttatctgaccggggctggtcgccagagggcctgatcttcttcggcaccgagctgctcctgtgcggggcgtcggcctacttctaccgcatcgccttcaccccctggacggaaaagcgggaggaggagggcctcaccccccggcagacggtgagcctgctcattctggcgggcaccctgctgctcaccctgtccaagatcaccctgctgggcgacctgtcggtgggccgctgcgccgccgcggcggcggtgatggtcaccgcctacaagggcggcatcggcgtgggggccacggtgggggtggcctgcggcctcgggatggatctggcggcgggaggtatgcccttctactccatggccttcgccctctccggggtgatgtgcggggtgttccaccggcagggccgtctggccgccgccctggcctacgtgctctccaatgccctggcggtgctgtggacctggtcggagggccttcacctctccctgctctacgaggtctttatcgcctcggtggtctttctggtcctccccgagcgcgccctgcgccaggtgggggcgctggtggcccgggagccccggcacgacacccaggagcgggcccgcgcctatgtccgtgcccggatggaggccacggcagccgccttcaagagcctgtacgagtccatgcggtcggccttccaccccgccgcacccaatgacaacgacgccgcatccgtcttcgatcgggcggccgggcggatctgcaagcgctgccccctgcaaaccgcctgctggcagcgggactacatctccaccttcaacgccctcaacgacgccctccccgccatgctggagcggggccggggggagagcggagacttccccgcctacttctccaaccgctgcatgaagttcccggagtttctctccgccgccaacgaggagctggccgccctgctgtgccggcggcagttccagagccgcctcagtgagaaccgctcggcggtgtgccgccaatatgccgagctggccggggtgctgaacacggcggctgccgagctgggggcggagctggtgcccgacccggtgcgggaaaagcgcctgcggcaatacctgaccgcccaaggcattgattgccgcctggccgcctattacgaccaggccgggcacctccgcctggagctggagggggcggggctggcccccctccgcaccgaggaggggacagccaagctttccaagctggtgaacttccccctccgggccgtggaggagggccgccgggaccggctggtgctggtacagagcgagccgttgatggccgtggccggggtggccgccaaaaagaaggacggccagaccgtatccggcgacacaggggcctggttcaagcacgacgacggctccctctatgtgctcctgtgcgacggcatgggctccggctccctggccgagcaggagagcgccctggccgtccgcctgctggagcagtttctccgggcgggcgtccggccggagaacgccctgcgcaccctcaactccgccctggccctgcgcaacgacgaggccgccggcggcttcaccaccatcgacctgctgcgggtggatctgttcactggcgaggccggggtgtacaagtacggcgccgcccccacctatgtgaaaaagggctactccgtcagccgcatcaccggcacggccctccccgccggcctcaccgccggggagggggtctcccccgacgtgacccgcctccagttggaggccggagactgtgtccttctggtcaccgacggcgtggccggcagcgcatccgaccagtgggtgcgggaccggctggccgcctttgacggcggcagcccccgggagctggcccaggctctcattgacgacagcggcgcccaggtgggcgccgccgacgaccgcaccgctctggtcctcaagctcgcccgccggaacggatgaaacagcagcccccggaaccaaaaggttccgggggctgttttttgcagtccggcaggtgctctctgtttgaaaacctctaccttttcaaacaaacgtctgtcctcatatttttacataatataccacaaatgaagggcaaaaacaagcgctattgctaaaaatttagcaatagcttttgttttgtctgcatgttttgacacttctgcccgcaggctgaaaaaacagaggtttcccaacaaagcccgaaagaggcgcagctcctcgccctccccctccaaatggtcatccattttcggatgtttatatagaggcacctgttttgaataaggaggaacgttttttatgaaaaagcgagtcttgtcagcgctgctcgccctttccacgctgctgataacaacacccgccgcatatgcggcagagcctgccacccagtcgggcggcgccgaaatcgactggccggagccgacctgcaccgtggactataagccgcagtccgacacggtaagctgtgaatttgtcgaagaaaccggggacgcgcccgccaagctggtctacaccatccaggagggtgcagagggcgaccaggttcttgagctgagcaagctggcggacgcccttgcagataccgtgcagtatcctggtaacgcggcgcagtttgacattgaaatccacaatgagtccgggaattcctaccgctacaaacccggcagcttcaccctggcatccgccgatacaagcggcatggaacagagtgaactgctccccgtgctgggctatgacggacagtggatccccttccgttttaccagcagcatggtttccaaccagatgctcaaagacctgtttaacaccagctcggtcaatatttcgcttgagcagattgtcaccctctacgacaccctggcggaagagggttatgacagcctgacaaactactttgtggcctggtataacaagaagaacagcacggattacgcctcttttgacgcgatcatggcggtcgcccccgccttctttgaggatatccagaagggcaatgccatgaaattctcctgcaccgctgaacaatttactgagttagagaagacacaccctgaagtgatgcgctgggcctacttcccctccggaaaggggccggaagacaccttccagctaaagtggccggagtccgggcttcagactgccggttatgacggctggtatcagtccatgtttgccttcgccttcggcgacgatatggccaacctgagcacacccccctccggccacacgtcctgccatgagcggggcgtcggcgactacatggagggaaccgacctctgggaacagaccgacgcatatttctgcggggacggccaggctctggcccccgagtccggctcagtactgagctacagcggcaagtgggcgctggatggcccatgtatcaggaacgcatatgcaaattatgaattctctttctacggctccatcaccctggaggaggtcggtccggttaccattacgccggtggatatgaccctgtatatcggcggcagctccgactattgggaggacgtcgacggcacccaccttcccgacgccgacagcggaatccccgccccccatttctacgtggagagcagcgaaatcccggcggagcatctggctggcgtcaccttccacggcaccggcgcggacggtacggaaaagtcctggaagctggcgccctacggcggcgaaggggaccagcaggccatcggcgaggacggccgaaaggtgtgggatatcgtctcggcggacccctccaccgccgccgatgcctcctgcctctactttgcggatgaggcgtgcaccattcccgccagtacagacaacatcgccggaaaccacttcactcacctctatgccgccatcagcacatccgacgccagcggtgcgggcaacaccggcctgtatgccgaggtgaacggccagaaatacgccctgcggtacggcgttggcacgctgaccgtccgctcggtgaccaacgacgccaccgggggtgagccctacaccttcgacgcggttcacagtgcgcacagcaccgtggaggcggccgccggcgacacagccgcagcggagaccgccacggacggcggctccaacgcgggcgtagttgcgcccgcgggcacgaagtacaccgtcaacggccacgagaactgggcgatggtgggcgatgagcagccaagcatcctgttcgacgacgtgctcagcagctacgagctggacggcggcgcggaatccgaggtgggccagaccatgctggaaaaggccgtcatcgacaacgccgacgcgcttggtctggacaaccccaacgaccgccagtatgagagcaaatacttcgacttggtggacgccggagacggcaacgtctgggtcaaggctgaccggcagctcgtcatctactggccctaccccgacgggatcacctatgagacggcgggcagctatgacttcgacgtgttccacttcgccggcctgcaccgcgagtacacaaccaacggcgaggtgcaggcgatggtgaatcaggcggccgcaaacatcaacaatgaaaagggcgaggccgccagcaacaaaacgctctccctgcaggtggaggaggtcgtgctgaccgagcacggcatccagctcattgtggatcaggaccgttacggcttctccccctttgtgctgtcctgggcaaaaaaggacaccggcggcggggatcacggcggcggggatcacggcggcaccacctactacaccctgcgctatgagagcaacggcggcacgaagtacgacagtgagcggtaccgccgcaacaccctggtagagctggacaagcagcccgtccgggagggctacacctttaccggctggtacgccgacaaggccctgaccgagcccatcgacgacatccgcatgacctccaacaagaccgtgtacgccggctgggaaaagaccggcgtgcccgaccggctcaacggcgacgaccatttcgcctacatcatcggccgggacgacggcctggttcaccccgaggccaccatcacacgggccgaggtggccaccatcttcttccgcctgctcaccgacgaggcccgggcggagtacctgaccgagaccagccccttccacgacgtggcccccgacgcgtggtacgccaccgccgtggccaccatggaggccatgggcatcgtggagggccgcgcccccgcggtctttgaccccgacgcacccatcacccggggcgagttcgcggccatcgcggcccgctttgacagtgcgccctatgacggcgcggaccgcttcaccgacatcggcggccactgggcggcggagtacatcaaccaggcggcggtgaagggctgggtggaaggccagccggacggcagcttcgcccctgaccggagcatcagccgggccgaggcgatgacgctggtgaaccgggtgctgggccgcctgcccgagaccgcggacgatctgctggacggcatgatcacctggcccgacaacccgccggatgcctggtactatctggcggtccaggaggccaccaacagccacgactacgggcgcaaggccgacactgtccacgaaacctggaccggcctccagcctgtggaggactggacacgctacgagcagtaagcctgtttttccgcaaaaaaacgcctgtaccgacatggtacaggcgtttttttgcgctgtcttactgcttggagaagtgctccttgccgacgccgcagagaggacatacccagctctcaggcacgctctcccaggcggtgccgggggccacgccgttgtcgggatcgccctcagcggggtcgtacacgtagccgcagatatcgcagacatacttatccatggttatagtctcctttttgatcaaatcgcaattcatagtatcacccggaggccgggaatccatgccttgccgaacccccgcctttgtggtatgatacatttactatttataacacattgggggacactgtgaaaataggcaaaatcaccataaattcaaagctggctttggcgcccatggcgggagtgaccgacctgggcttccggacggtgtgccgggagctgggggcggggtacaccgtgacggagatggtcagcgccaaggccctgtgctatcaggacaaaaaatcccttcccctgctggagctgggcgggggggagcacccggcggcggtgcagctctttggcagcgacccttactgcatggagcaggcggcgggcatcgccgcggagaagtcgggggcggacattctggatatcaatatgggctgtccggtgcccaaggtggccaactccggggatggctccggcctgatgaggaaccccgagctggcggtgaaggtggccgaggcggtcatccggggggcgggcggacggcccgtcaccgtcaaattccggctgggctgggacaagggctccatcaactgcgtggagttcgcccaggccatggaggccgccggtgtggccgccgtggcggtccacggccgcaccaaggtgcagatgtactccggccgggccaactgggactatatccgggcggtaaaggaggccgtgtccatccccgtcctcgccaacggcgatgtctttgagccggaggacgcggttcacattctcaaatacaccggggccgacatggccatgctcggccggggctgcttcggcaatccctggctctttgcgcgggcccaggccgccctggaggggcggccggtcccgcccctgccgccgctggcccggcggtgcgagacggcggtgcggcagttccgcctctccgccgctcagaagggagagcacatcgcctgcctggaggcccggaagcactacgcctggtacctcaagggggttccctacgcggggtattataaggaacagatcagcaaaatctccactctggaggacattgaccgcatcaccgcaggcatacagcgggatctgagggactgaccgccggcaaacgcgccggcaaggaggtgagaaaggcatgaccgaggaacaggcgctggtacagcgggcccggcagggggacgagggggccttcgccgccctggtggaacagaatcaggggcgcatctaccatctggccctgcgtatgacgggcaatcccgacgacgcggcggagctgtgccaggaggcctttctcaacgcctggaagggcctggggaaattccagggggagagctccttctccacctggctctaccggctgaccagcaacgtgtgcatcgactttctgcggcgggagaagcggcgtagcaccctgtccatgacggtctccctggacgatgaggagggcgcccggcaggccgagctgcccgacgagcggtacagtccccaccgccaggcggagcagcaggagctgcgggacaccctgcgggcgggcctgcgggccctgtcggaggagcaccggcaggtgctgattctccgggagctggagggcctctcctatggggagattgccgccctgctgggggtggaggagggcaccgtcaagtcccgcatcgcccgggcccggctggccctgcgcaaatatttgctggaacaggggaactttttcggctccccctcgtccaaagcataaaccagatccacgggacggaaaggaggcggcggcatgctgacctgtgaacaggcgctggagctcatcagcgcgcagctcgacggggcgctgacggcggaggaggccggggctctggacgagcacctggcccagtgcccggcgtgccgggcgcttcgggccgatctctccaccctgcaccagcttctgcccactctggcggaggagccccccgccgggctgaaggacgatatcatgaaggcggtccacgcctccaaatgcacccccttccacaccggaaagcgccagtggcgctggcgctcctgggcctctctggccgcggtgctggtgcttgtactggtgggcgggcaggccgtgcacctctggagccctccgggcagctccgggagcgtacccagagccaatcttgccgggttgaccggagcggcctccggcgggagcgccggacaaaccgccccggctcaggaggaccgcgcgggccccgccggggagcccgccgaggccgccagcggcagcgccgacggcgccaaccggaaggacagctccgccggtgagaggccccagaaccgggacgtgacgccacccgccgatggaccggagggcggccagataccggcatctgctcaggagccgtctgtctccgcgccgcctgtctccgagctccagcctaccccgtccgcggggccctccgtcatgtccctgatgcccgaggacgccccgcaggacacccagcccccctcctccgccctgacggaggagggcgcacgccaggcgctgctggagtggctgggccagcccggcacgcctctgacctcccttggccggtcggaggacgggatggcctaccgcttccagacggaggacggggctctttactccgtccctctggacgggagtcccatcactgcggaaccctcctgacctgcacacgcggccggtgttaccggccgcgtgtttttattcggctgcggcacattgagtctgtctccccgctcggctccggccccaagcttgtctcccggcggacattccctccccctctcccgcgtgcaaatttcccccctgcggactgcggcggggtattttgcgcgatttttctaaaatttcagttgtatctccggttgatttaatgtataatgaacaacaggcagtcctccgtccccctcgggagccctgcccagacgattccaaatgtaaggagaggaaacaagtatgagctattccgtacaaaacatccgcaacgtctgtctgctgggccacggtggaaatggtaagacctccctggccgagagcatgctgtatttgaccggtggcaccgtgcggctgggcaatcccgccgacgggaataccgtttgcgattacgaccccgaggaaacccgccgtcagatttccatctccaccgcggtggctcccgtggagtacaacggctgtaagatcaacgtgctggacacgccgggctactttgacttttccggcgaggtgatcgaggccctccaggtggccgacgcggccatcatcgtctgctccgccaaggcgggcatgagcgtgggcgcggagaaggcgtggaagctgtgcgagcagcgcaggctgccccggctgctctacatctccaagaccgacgaggagaactccgactacaacgccgccttcgacaccctgcgggagcgcttcggcaagaatatcgcccccgtggccgcccccatctgggacgcggacaagaaggtcattggctttatcgacgtgctccacaagcgcgcctttgaggccggccccaagggcgagcgcatcgagatcgacgtccctgacgacaagaagcccgtgctggacgagctgtacgatgccctcaaggagtcggtggctgagaccagcgaggagctgatggacaagtacttttccggtgaggacttcacctacgccgagatgatccagggtctgcgccagggcgtgaaagacctgtccctcttccccgttgtgtgcggctccgccgtctccggcctgggcacccgcatgctgctggacatcatcgtggagctgctgccctcccccctggagggccgccccctcatgggcgagaacgccgacggcgaggtggacgagttcgtgcccttccccggcgccctgcccgccgccctggtgtggaagaccgtctccgaccagtacggcaagtactccttcgtgaaggtcatctccggcaacctcaagcccgacatgcagctggtcaattcccgcaccggcgccacggagaagctgggccgcctgtacgtgatgaagggcaagaaggccgaggaggtcaaggagctggagtgcggcgacatcggcgccatcggcaagatggagaaggtcaagaccggcgacaccctctctgatccccgcaaggtggtcaagctggaacccatccccttccccgagccctgctactccgtggctatcacccccaagaccaagggccaggaggacaagatcgccgccggcctcatccgcctgaacgaggaggatctgaccttcaactgggtcaacaacgccgaaacccgccagatggtggtctccggcaccggcgacatgcagatggacgtgattctctcccggctgaagagccgcttcggcgtggacgccgagctctccgagccccgggtgccctaccgcgagaagatccgcaagaaggtggaggtgcagggccgccacaagaagcagaccggcggccacggccagttcggcgacgtgtggatgcgctttgagccgggcgacaccgaggagctccagttttgcgaggaggtcgtgggcggcgcggtgcccaagaactacttccccgccgtggagaagggcatgcgggaggccgtggttcacggtgtgctggccggctacccggtggtgtacctgaaagccaccctgtacgacggctcctatcacccggtggactcctccgaaatggctttcaagaccgccgtgcagatcgcctacaagaccggtatgccccaggccagccctgtgctgctggaacccatcggcgagctgaaggtcaccatccccgacagctacatgggcgacgtcatcggcgatctgaacaagcgccggggccgcgtcatgggcatgaaccccgacggcgagggcaaccagatcgtggaggccgaagtgcccatggccgagatgggccgctatgccatcgacctgcgctccatgacccagggccgcggttccttcaccttccgcttcgtccgctacgaggacgcccctcccgccgtccaggagaaggccatcgaggccgccaaggcgatgcaggacgaggccgactaacccaatatgtaaaaagggccgggctgatttcagcccggccctctctttaaagcagcgtatcccccgccgctttgcccatccggccacccgatgataccgggcagatcacagtccgcttggggtacgccccttgtgtcctggcgaatacaggccgaatttattccatgcataccattccgctagctcctgctctgaccgaaatttcagcagccgcagtatctcttttgccagctccagcgctccgaatccgttggcggtaagaatgccgttgtcacaaaccgcctccgcctcaacgaaatatgcctcccctttatagtgcggagcctgggatttgaggaagggcagggtattcccagtatgtctgcgctggtctaaaaaaccgttttccgccaggaagtttaccgcgttgcaaattgcagccaccgggatatggcatctgaccagttcccgtacaaccggcaagacagcgtcatttttccgctccagccacgctgtcccgccggtcagcagcagcaggccggcatcccgcggatagtcagcgacagtaaaatcgggcgtgacacggaagccccccatagacaccttgggcgcccggtcaagcccaatggttttcaccgcatatccagttccaggtgcatttaactgcgcacatacataggccggttcccagtccgcatagccatcaaaaataaataccaggatttgtttcatcccttcataccacctttctgtagacagcttaacacaaaaaaggtgacagcttagctgtcaccttttgtaaaagtcgtttatctttttcagctcatctctgagctcctcacggagctcaggtggcgcgaccaccctgaccttgcccagcagccccatgacaagctcccgtgcaaaggaaagttcgggggcataaaaacagatccggccggtgtcactccccccaccaggcgcatccaacaggcaggcatctattttctctgtcagggtaaatgcgtcccggcgctcatattccaggacaatctggtaatatccgtcctttttcacggcagacaggccgccccctccaaaccgctgttcaaatgttgtttcgtccatttggcgcgtggaaaagcgctccccataggggacgcaggagacgatacgcctgagcttaaacaggcggaacgcgcttcgctcccgacagaacgcatacaaataccagtcagactgtttgaacaccagcttatggggttctaccaaccgggtccggcgccctgtttttgacacataatccattttgcacaccatgcggttacaaattgcgcggtgcagctcagagagctttttccaggtaatgctgtccgtaaaccacggggtgtagtcaagcagatagcggctgcgggagcgtgcgtcagtctctgggaccggaaccagtctggccagcagtgccgaaaccgagccatctccgacaaggctctttaatccatccagggcggtaaacaggctagcgatatcctccctggaaagcagtcttttgtcttgccggtatcccttcaggatggagactccgccccctctccccgaccgtgaggcaacagggaaccccgcatcgttcagggtttcaatatctcggaggatcgtccgcctggatacctcaaaccgcaccgccaactcctgaaccgttatatgctctacctcggcaagtaccgagagcagccccaacagacggtatattctcattttgctctcctttcccctgaaagcagaaggaacagatttctcaccagtttaaaagctggtgagaaatccgttcttttcgatgacgggcacactccggatctgcggaagtgccagtgctcaaccattcttcctacttgtggtaaagcttgttggtctcatactggggctcgcaggtgaggcgcaggcccaggcggctgtaggtgctgctgtccaccggggagaggatgacggtggagtgggcctcgcacccccgcagggcggagagctgatccagcgcccgcttggccagcgggttggtggtggcggagatggccagggcgatcagcgtctcatcggagtggagccgggggttgacggagcccaggtggttgaccttcacggcctggatgggctcgatggcctcccgggagatgaggtggtgctggtgatcaatgcccgccaggcgcttgagggcgttgagcagggtggcggaggaggcgcccatcaggtcggtggtcttgccggtgaccacctcgccgctgggcagctcaatggctccggcggggttgccggtctcctcggccacctgggcggcggcggccaccacgggccggatggagggatccacatgggcctgctgcatgagcagctccagcttgttcaccagctcgtcgccagcggcgcccacccggcggtcgcacagggcggtgtagtagcggcggacgatctcctgccgggctgcggcacagaccgcctcgtcgtccacgatgcacttgcccgccatgttcacccccatgtcggtgggagacttgtaggggcactcccccatgatcctctcaaacatggcggagaggacagggaagatctccacgtcccggttgtagttcaccgtagtttcgccgtaggcggccaggtggaaggggtcgatcatgttcacatcccccagatcggcggtggccgcctcataggccaggttcaccgggtgctggaggggcaggttccagatggggaaggtctcaaacttggcgtagcccgccttgatcccccgcttgtagtcgtggtagagctgggagaggcagacggccatcttgccgctgccggggccgggggccgtcaccaccaccaggggacggctggtctcgatatagtcgtttttgccgtagcccccgtcgctgacaatcaggccggtgttgtgggggtagcctgcgatggggtagtggaggcaggtctgcacccccaggtgctccatccggcggcggaaggcgtcggcggcgggctgtccggcgtactgggtgatcgccacgctgcccaccagcaggccctccccccggaaagcgtcgatgagccgcagcacgtccacgtcgtaggtgatgcccagatcgccccggatcttgttcttctcgatgtcgctggcgcagatggcgatgaccacctccaccgagtcccgcagctccttgagcatacggatcttgctgtccggctcgaacccgggcagcacccgggatgcgtggtggtcgtcaaagagcttgccgccgaactccagatagagcttgttgccgaactggcggatccgctcccggatgtgggccgactggagctccagatacttctgattgtcaaagccgagcttgtccatctttctcatcctctcctgtcattcattcaatctgttattttaccacatccgccgtccccctcaaagccctttttcccatttcggcaaaattgacaaccgctcttgacaggtagctcctacaggtgtagtatcattacgaatgcgacaactgtaggagggctgtgacatgaagctgagtgacaaggagtggagggtgctgaacgccctctgggtggccccggaggggctggccctgggggccgtggtggacgctctgcgtccggatacgggctggagccgcagcacggtgctgacctacctcacccgcatggaggccaagggcctggtggacatccgcaaggaggacttcccccaccgctaccgggcggcggtgagccgggaggactgcgccgcggcggagcgccggggcctgctggagcgggcctaccagggctcggcgggcaaactggtggccgcctttttgaaggacgagaagctcacccctcaggagcgggacgagctgcggaagctgctggacgagatggaggtgtgagccgtggacaacctctggtctgttctcgctcagaccctggccctgtccgtggcggcggcggtgctgctcgccgcaaagcgcctctttctggacaagctctccccccggtggcagtacggggtgtgggccattctggccctgcgcgccctcctgcccgccggcctgctgggccgcaccctggtgcccggcgggcgggcggtgctggaggcggccaggctccaggtggaactccccctgtcctccgttctcaccgatccctacggcgtaacggaggtgctggccccggtgcccctctttccccgcggcctgcctgtgccggggagcatcaccgacgtgttcttctacgtctacgccgccggggtgctcctgctggccctgtggtttttccggtcctacacgcgcctgcgcgctgccatccggcggggcctctcccccgccccggaggtgctggcccaggtggagggcgtagcggcgcggtacggcctgaaggccccccggcgggtggtggtgctgcccgggctggagagcgccttcgtctgcggccccctgcgcccggtgctggcgctccccgaccggccggtggacgacaaggtgctcctccacgagctgctccacctccgccatggcgacgtgtgggccggggtgggggtgtgcgccctgcggtgcctgcactggtgcaacccactgatctggtactgctgcgaccggatgcagaacgactgcgaggccctctgtgaccagcgggtgctggagcggctggagggggaggagcgccgcgcctacggcgtgattctcctgtccatggccgacggccggtacgcccgcgcccccggcacctcctccatggccaacggcgggcgcaacatcaaggcccgcatccaggctatcgcccgcttcaggcgctaccccgccgggatggccctggcctcgggctgtgtggccgtggtgctggccctcacctgcctggggggtaccggcggggcggtggaggtgcccggcggaaccgaccggggcgctcttgccctggctcaggcacagctcaaccgccccaccaccgtggccggagccttggacacctatgccaaggcgctgctcagcgacagccccctgtactatgccatggtgctgccggaggaggggcgggaggccgtttggaaggacaccctggtcccctaccaagaggtggagctggaggactcccctttctggaccctgggcttccactggcaccgcccctcctggctggcggagtggtcggtaatgaacctcctgcctgacggggcggagggctataccggaacgctgtttttctcccctctgtcggaggacaacacctatggcatcgtgtaccagcaggtggcggtacggcccgacggggacttctggacagtggagccgctgggggagctggaggcgctgcgcctccccgatgagggagcgatcccggcccccgacgaccatatcccccacatcacctacgcggcggaaacggtagatctgcgcctagaggtcgatctcacctactttctcacctgctccgacatctgggttgggtacatgtcgctctcagacggcggctgggccggcggcaggacgttccgcatcggcggcggcgaccgtcccagccccgttcccgcccctcacgccgcgtttacctcctgctgcaagcgcagcgaactgagggtggagcgcaaatccggaggtgttccgtacgactttctgtccaccctcgccgtgctctgcgttcccctttcctccgatggctctcccgcttttgacagctttgtgctcaccgcttatgaccttcccggagtcagcggtctgtggcacgccgcggctgacgactccggcctggaggggctctccgcgctctccctggattttgtctatggaaaccagagatacacctgcaccgcctatcccgcggaggtgacgccatgaatcacgcaggcatccgaagcgccctgagccgcatcgcctgggcctatctcctcatccatctgcacttccgcctgaacaacctggatgtgctccccgactgggctggctacctcctgattttctccgcgatcggcctgctggccggagagctgcgggatctgcccctgctcaggcccttctgcatcctgctgggcgcggtgtccggggtggactggctgtcctttctcctcaccggcgcggagttcaccggccgcttctttctcctctccgccctgatcacctgtgtggccctctatttccacttccaactgctcaccgatctggccgccctggccgaccggcggtcaggggagggcggccgctcccccctgggccgccgcctgcggctgtgccgcaacgcggacgcggtgttccgggtggccttctgcctgctcccctatctggcgaactggcggtgggtggagctgctgattgctctgctgtccctgctctggctgggcacctgtgccgtcatctgctgcgggctcttcgccctgcgccgcctctatcccgcggaggaggacgaatagggcgaagcggcggggccgcccctgcgtccttgtgccggagtccgctccccccgcgctttccgcgcaaacaaggggccgtgccgccaaaccggcggcacggcccctctctgctcttattcctgctccatatggctcttgacccgctggatgatcatatccagggccaccgcgtttttgccgccctccggcacaatgaggtcggcgtagcgcttggagggctccacaaactgctcgtgcatgggcttgacggtggtgaggtactgctgcaccaccgagtccagagagcgcccccgctttttcacatcccgcatgatgcggcggaggatgcgcacatccgcgtcggtgtccacaaagagcttgatgtccatcagctcccgcagggcggggtccacgaagatcagaatcccctccaccagaatcacccgggcgggccgcacctccaccgtctccgccgcccggttgtgcacggtgtagtcgtaggtgggactgtgaacagcctccccacgccgcagcgcctggaggtcggcgatcaacagctccgtgtcgaaggcgtccgggtggtcgtagttgagcctgcaccgctcctcatagggcatgtcgtcgtgctgcttgtagtagttgtcgtggtagaggatcgacacgtcctccccaaagtgctccttcagccgcagggtgagggtggtcttgcccgacccggttccccccgcgatgccgataatcatggtttccatgcttccgcccccctgttttttctacagtataacacagggcggcgggaggtacaagcctcccgccgccctgtccggctagggtttgagcacaatgcgccgcgggccccgggggcgcacccgcccgacggcggcggcggtcacccccgcgtccgccaggcggcgcagcagctccgccccccgctcctccgcaatggccaggagcaggccgccggaggtctgggggtcgtagaggcagtccagcaccgcctgggggaaggtccccgccgtctccacctccggcccggcaaactccagattgcggtaggcccccgccgggatgatgccgtcccgggccagctccagggcctggggcacgatgggcacccgccccggccagagctcgatggtgcacccggccccctccgccatctccctggcgtggccgatcaggccgaagcccgtcacatcggtgcaggcgctgggccgcaggggcacggccgcccgggccgcgtcccggttgagcgccgccatcagatccgtcatcgcccggtactccgccccgctcagcagctccgccttggcggcggtggtcaggataccggtacccaggggcttggtgagcaccagcagatccccctccctggccccccggttggtcagtaccgctccggggtggaccaggccgctgacgcacaggccgtacttgggctccgcgtcctcgatgctgtggccgcctgcggtcactgcgccagcctccgccaccttggccgcgcccccctccaggatggcccccaccgcttcccgcggcaggcaggaggggacggccagcagattcatggccagcctgggctcgccccccatggcgtacacgtcggagagggcgttggccgccgcgatctgcccaaagtcataggggtcgtccaccaccggcgggaagaaatccaccgtctggatcagcgccagctcatccgtgaggcggtacaccgcggcgtcatcgctggagtcatagcccaccagcaggttgggctcaagcgtccggggcagcccggacaaaatctgttgcaggacacccggtcccagcttggcccctcacccaccggccgtggtcatggcggtcaggcgcagcttctcatacggcatagactcaccccctctctttttttatagtgtaccacagcctccaggcaaaaggcaaccataccgcgccgcacccccctccccctccacgcatacgctggagtgagaaactagagacttggagggtcatttatgcaagcggaagcaaaggtttgtttttatctgggcgccaattcccccaccggcttctactccctgtacgaccaactgcttgagcccgagcaggccgaaaccatctacatattgaagggcgggccgggctgcggcaagtcctccctgatgcgccgggtggcccaggccatggaggagaagggggcttcggtggagtacatcgcctgctccggcgacccggactccctggacgcggtggtgttccccgccctgaacaccgccattgtggacggcaccgctcctcatggctgagcaacagaaggatactttaggtatctatctttgtgtcatcggttatctgtccctgcaccggccggttcatttcgatccaaacccggtttacctcttccatacaggtaaaatagagactggtcagcagattcgtaggaattccaagctctccggtcagtctatcaatcttttcccaatccgcatgttcatagctcagggccagatcgtacagcattccagcccggccggtatgctgtaaaagggcctccttagcctccgcacacagaggaatgggcttcagaatctccgccagcggagcatcaatgagataattcagggtagaaaacatccccattaagtaggcatccggcttggagatcggcatatcctttgcgtagttcatcagcttgctacagaagttggcccgcatgaacgacattctgagaaactcctccgcgccctcctccatctgattctcggcattgctggcgctcagcaggtagacccattgacgcagttcgctcaggcccatagtcatgatcgcctggcgtacgctggttacccggtggcggagcgcataatagcaggagtttgccatccgcagcaggccataggtcagcgtagcatctacggaaataatctgctcaatctcctccacatccggctcgtcccgcgtcatcgccaccatcaggcggaagaagttgctctgcaaatatccgctgctgtgggtctgtgtggtcagcttttccgccacataggggccctccagggcatccacccccagcttgacggccttctggtaggtttcctcccggtcaatccccacggcgatacactgctttttcatgctgtgggcgatgtcgatgatgtttttcagcgtcagctccggcgtggtctggatgttcagcttaatgtagtcgatccggtccaggattcccagatagcgcggggcaaactggaattcattgaccgccacctgatagccctcttttgcatactgctgcaccatatgcatggccaggggatgaatgataacgctgtcgtcaatctggatcaccagctcccccttgtcaaagaggtggggcgtttttttcatcagaagcgtggtggtgaaggtcataaaattcagtgagccgcgcagcagcttatcggtattcatggtgaggaaattgtaaatggtgtccgctgcggcaaagtcgttctccctgacgtttttgccgttgtcgccaaaggcctggttttccccgtggtactggatctcatagccgatgatcttatttgcctggtctttgatgggctgacgaacgatatatttgctgctcatgcctgtcctgcctcccgcttccgtctgctgcgctccaaaagatggtccacaattccgatcaaatgcccgatttccggcttgctcaactgctcatccgcaccgacctctttgcccttgcggcgcatctcctctgtaatcagggaggagaaaatgatcactggaatggcctgcagctctttatcctccttgatccgcttggtgaggttatggccgtccatctggggcatctccaggtcggtaatcacaatagaaacctgtccggtggggcccccgccgtccttacacgcctgcagcgcctcccacagctctgcgccgttttggaacatgcgcaggttggtataccccgccttagtcagcgcggtacggatcatctgggacagcaggatggagtcctccgcgacccagaccggctcgcttcgcttctcccgcttacccatagcatccacctcactgagctggataccggtctccggcgcaatctcggccacaatcttttcaaaatccagaatcgtgaccaagtccttgccgcactgagcgattccggtggcaaccccgtctgcgcccccggaaaccgtgttgtccggcttctggatgtcccgccacgagatacggctgatccccactaccgtatggacgcggaaggcaatgtgcattttattgaaattggtgataatgaagagatccttttcccctttgggttcggtatgtccactgagatactccggcagatccaccacggtaatcacgatgtcccggggtttaaaaatcccttccactgccgggtgggcatggggcattgggtgcaccggcgccgacagcataatctcacgcaccttggccacattgatcccgtagagatttccgtcaatggtaaactccatgatctcaatctcgtttgtccccgtctccaataaaattccgtctttgttgttttccatgacccattcccccactttcagattgttctattcctaccggctaaaaaatgagctccggctttccgtagcagcggacacagccttgtccggtggccgcgtcaaagagcagggtccgggccaccgtgccgcctacatcctcctgtagcagccggacgccctctgtacgcagcgtcatatggacgctttcaatattccgctgtccaatattgcccagatttccaccgccggctacctcaaacatgcgggctccgccggcaattttggctgtaacccgcgcccgtttggcgcctcgccgctccatttcccgcagcgtctcccggatgccggtatccgcatacttgagcggggacttccgccccgtctccagattcaggggcagcatgatgtggagcagggcggccagcttgagcatgggatcatagaagcagattccaatgcaggagcccagggcgtaagtcaccagcatcccactgccctgcgccattttcatgtcggcgatcccaaccaccagcttgtcattcatccaaaacacccagcttccgcagcaggaaattgagggaacgcacgtcaggtgacagcaggaggcggcagggcacgctgtgcttttcgcagatgaaattggtgccgatggtcataatgtaatccgactgtcctccaaactccgccatgggcaccgtaataatcgccccctgcatgtccacagcaaagccaggcaccgatggctgaatcgttaccccagccaatccagagagggcgttgacgaaggtggagatcatgatgttgcccacctctaccagggctgagcggtccagctccgagagctgcccatattcgcaaaccgtccggttcatcatgcggcccagcacctgattgataaagtccatctgctgtaccgagagcataataccgttgatttccccgcccagacgcaccagcacaccggccgtgatcacctccggcccgccgatccagtcgatggcctcgttgtaaccgaggatgcgcacctccggcatttcaatgcgcacctcacactggagcaggctggagagggccgtcgccgcgttgcccgtcccgatgctgccgatctcccggagcgtatccagttccaggccgctgagttcattaaaatttttcacgtattttccctgcctatccgtttgtcaggttgttgaccgtcgtctcgatttcgtccgctgtctgcatcatgcgcaggacatagctgtaagtccgctgggcctcaatcacctttcccatctcagaagccaagtccacattggagctctccagatagccctggcgcacctccgaggggctcatccacaccgcaccgtttttctccgtggtcacaaaccggccgctgcccacatgctgaaggccgtccaggtattgaatggtaaacacgcccacaggctggcgcgcctcagcgtccgtcaccacaatgggatagccgttggtgtccagaacctgccggccctctccatccgccagatagtaaagtgtatccgttgttccgtcctcctttatctgctgaaacgaggacagggcgaaggagccgtcccgggtgtaggaaatctctccggtatccgggtcatacagggcgaaaaagccgtcgcccacaatggcgtaatcctgcttgcgccccgtctcctccatcgctacggagcggaaatccgtgatggtggacaccatgcgggtaccgctgcccttggggagctgctggccgtcgataccgtctaccatccggtacattagagcctcaaaggcgggcttctccgcccggaatccaaaggtgttcgcgttggccatattattgccctggactcccattcgctccatttgctgctgcgcgcccaccgtggcggtataaaaagcctgaagcatcgttctcctcctctgcttataagcgtcccagctctgttgtcgccttggtcagcacgccgtcatagagcttcagcacctgtgcggcgctctgaagcgcccgctgggccgtcatcatatcgctcatctcctggagcatgtccacgttggcattctccacccatttccagtggagctttgcctgggagggagccggcgcctgcccattcgcaccgaacaggccgctctcatttttctccagcagcccgttgtccgcaaaggcatacaggcccagccggcccacatagccgccgccctctgtatagaggttccctgcctgatcggcccggatacggtcggtggccagatagaccggttgtccatccgcccccaggacccgcccatgggcgggcaggcaaagatagccctccccatccagagaaaagctgccgctgcgggtgtactcgacgccctgagccgtctggatggcgaaaaagccatccccttcgatggcgaagtcgagcgtcagccccgtctcctccaggcttccctggctatagtccacatagagctgactgggagccaggatatagctctcctcaccgatcacggtggggctgcttttgtccttattacctacccggctgatcagcacttcctggaaggtgctgtccgtatactgctccgccttatacccggaggtggagagattcgtcatgttgttggcaaccgtgtccagccggcggctctgggacaggatgccggaggtcaggttgtaaaacccttttgtcatatggccttctcccttctgctgtgtactacgctcctatgtactgcttcatgtaggcctggagccgctgaatggcccggttatggatttgtgaaatacgcggcgcgctgaccccaaggacctgtgcaatctccttcatggtcagctctttttcataatacagggagagcaccagccgctcattctcccgcagggaggcgattccccggcgcagcacctcgtgcagctccttttgctgataagcatcctccggcggattgccggacagtgccttgccggttacattcccataggtgtccaaaagcacctcgaaagacatcaggttggaaaacgccgtttcagagaggagctcctcatagtccttctggctgagcttcaggtagtctgccatctcctgatcgctgggggtatggcccagctctatggacagctcctcagccgcccgcttcagccgggtggccttctgccggaccctccgcggaatccagtcctgcttgcgtaccaggtcgatcaccattccccgcagccgctttgcgatgtacgcctcgaacttgacctccttttcggggtcatacttgtccacagcgctgagcagaaccaaaattccctcatggatcacatcatccaactgggtaaacccgctgaacagcccgcaggtctgaatcgcaatccggcgtaccagatcggtataccgcagcaccagggcccacttcagctccatatcccccgtctccttgtagcgcagcagaagggtctgattgtccatctggtcgaccgcctgctgacctccgccgggggatagggccgtttccatctgttttaacttattcatgcagatacccttccccatctctatgcacgcttttcctgcggctgaagtgtaatgttgccaatggcctgtatctgcacattgctcgtgatttcattaaaggagagcacatagatgtcgggatagaatgtggcgagcatacggctgagatagacacggataatctggctggtcagcagaatgggcgtttgggagagctcctcaaatttcttccgcagctctcccacctgctgtacgatctgctgcacaatatcagggctgagcgccagatagacgccgtgctcgttcttggtcagggcggccagtaccttcttttccagctccgcgtccagcgtcactacccgaagctgcccattttcgcagaacttccgggtaatggtccgtcccaatgcaccgcgcacctgttcggtgatcatgtcgatatcatgggtcgtggtactggcctccaccaccgcctccagaatggccgccagatcccggatggggatgccctcccgcagcaggctgcgcaggatcttttccaggttggcgtaggagatgacgttggggatcacatcggccaccagctccggctccgtctttttcagattctccacaagctgcaaggtctccgagcggttgagcagctcataggcatgctttttgatcgtctccgacaggtgggtaagcataacggtcaggggtgtgataaccgtatacccgtagatctccgccatttccttgttctccggcaaaatccagcgggaggggatgccgtaggccggctccaccgtctcaatcccgtcaatcgtccccgccggattggacggctccagtgccagataatagtccaccagaatctctccccgggccacctcctccccccggattttgatcacatactggttggttcccagcgccgcaccgtcgtggaggcggatagaggggatgacaaagcccatatcctgggcatactgccggcggaatatcacaatgcggctgatcagcttgccgccgcttttctcatccaccaacgggatcaggctgtagccgaattccatctcgatcggctccaccgccaggagggaatagacattgttgatgtccttgaagtagtcggtttcgctggccgcctgaagctccggggtggctgccgcctccggggcgggctgttcctccagtgccttctgctcagtgagcttccggtcgctcaagaagccgccaatacccaggccgcagcccaccagcaggagcggcgccgtgggagcgccgggcaccagccccagcagcgctaaaataatgccggtggccaggatcgccctgggctgggccttaaactgtcccagcacgtcgctgttcaggctgccgtccgacacggaacgggtgacgatcataccggtagcggtggagatcatcagggccgggagctgggacaccagaccgtcgccgatggtggcgatggaatactggttcaaaaccgtagccagatctccgccgccctgcacgatgccgataattaagcctgccacaaagttgatgaccgtaataatcagcgacatgacggcgtcgcccttgacgatcttggttgcgccgtccatggcgccgtagaagtcggcctccttctggatcttataacgccgcagccgggcttccttctcgtcaataaggccggagctcaaatccgcgtcgatggccatctgctttccgggcatggcgtccagcgtgaagcgggcggccacctcggagacgcgctccgctcctttggtgatcacaataaattgcaccagtacaatgattaagaaaatcaaaattccgatgacaatattcccctgggtaatcagcgtaccgaaggatttgattaccatacccgcatcgccgccctcggagaggatcaggcgtgtggaggatacgttgaggcccaggcggaacagggtcgttatcagcagcagggaggggaagatagagaactccagcgcctccgagatgctcatggtgatcatcagaatcatgatggaaatggcaatgttcagtacaatcaggatgtccagcgcctgcttgggcagcggcaccaccagaaagagaacgatgatcacgaccagcagcgatatggagttgttcagtatccgtctcataactctccaaggctcctactttctcgccgctacttcagcttttcatccatgcggtagaggtacaccagcacctccgccacggcgttatacagctccggcgggatctcccgattcagctccgccgtggcatacagcgccctggccagcggtacattttcaataatggcaatgtgatgctcctccgccttgcgcacaatgcgtccggccagctcgtcctgtccctttgccaggacaatgggcgccccatccgtctcagggcggtagcgcagcgccactgcaaagtgcgtcgggtttcggataaccacatctgcctttggcacctgctgcatcatacgggattgggccatcctgcgctgcacttctttgatctttcccttgacctggggatcgccttccatctgtttgtattcctctttgatctcctgtttggacatgcgcaactgccgctcatagtcccaccactggtaaaacacgtccgcgctggccagcaccacaaaggctatggcgatctgcatcaccatctggaagccctcatccaccagatgggcgcaggcaacggccagatcggtgtggagatatttcgtaaaggtatctacaattcccaccaggaactgatagatcaggaacagcagaaccgttatctttaaaatccccttcagcgcctcaatgacgctgcgcagtgaaaacaggcgcttgatcccctgcagggggttaatccggctgaacttcggcttcagcgcctccccggaaaccaacagcttggtctggaaaaaggtcgccgccaccgctaccaccgccgtagtggccagcagcggtcccgccgcaaacagaaaggtcttcagcatctccagcaccaggccgctcaggttgtcctgcaatccagtgtgcgccgcgccggccacaagccccatagcgtactgcaaaaagcggtaaatctgctccaccattggcgtggcagtcagcttgagtacaaaaaagctggccagcagcaccgccacggaaactgcatcgttgctgaaaaagacattacccttttttcgctcgtctctccgctttttaggggttgctttttcggtttttgaactgtctgccaaagccttctcacgctccccctatcaggcgcagtatccgccccagctccgagagcatgccgctctccagctccagcaggaattcgttgatcggcgtcaagagcagaaagaacaaaagcagcccgatgatcaccttcagctcgatattgatgacaaaggcgttgatttgcgggatcgccttcatcagcacccccatgcctacctctcccagcagctccgctgccaggatcggcatagccagctttaccgccaggagcatacaggcgagaaacagctcaatgacataggcgtagactccatcgccaagggcggcagcgccatagggaaccagctcaccggaggtggtcagcaggcgcatcagggtatagtgtccattctccgcaaagaagtccagaatcagcaggatattgagcagtgatgcagtcaccgacaggttggcctggctgctggcgtcgtagatctgcgccattgtcatacccatctgtgtgtcgatcacctctccgccgatctggacaacggaaaacaccacccgcattacgaatcccagaaccaggccgattcccagctccagcagaaggcgaaacgccagctccaccagggtatccggctgcggcacccccgtcccggccgtcccaaaaaccagaatggagagcaccagcgccataccggtcttgaccatggccgggagattggagcgtcccagcagcgggttaaacaggagaaagcccgacatgcgcataaaaatcagttcaaagagatagagctgtgcccaatcgaccatgtcccacacccttacatcagcgtaaacagataccggctgaaatccagcagcgtctccagcatccatccaccgcccaccagaagtacagccaccaccacgatcatcttgaggataaacgagagggactgctcatggatctgggttaccgcctgaaaaatggcgaccagaataccgaccagcatgctcagaatcaggagcggtgcgccaatccgaagcgcgacgcccaccccttcccgcaaaatgtcaactacttccatattcggattctcctatcggaagctctgcaccagggtcgagaacagcagctcccacccattcagggcgataaacagcagcagcttgaacggcatggagatcatactgggcggaagcataatcatgcccatggacatcagcgtggaggccacgattacatcaatcaggacaaacgggatgtacaggtaaaatccaatcaggaaggcatgcttcagctcacttgtcataaaggccggaaccaaaacccgcagcggcagctccgcggccgatgccgcagacggcgtatccagtcctgccagatcgcagtagagcttgagcgagctctcctccacctggcctgccataaactccttcaggggtttctccgcccgctgcaaaaattcctcctgggtaatctcctccgcaatatatggctcgtatgcggtggtctggatctcactgatgaccggagacatggtaaacagcgtgagaaacagggcgatgcccacgaggaccatattaggcggattctgttgcagccccatggccgagcgcagaaaggagaaggagataatgtacctggtaaaggaggtcatcatcacaactgcggagggcagcagggtcaacagggtggtcagaaacaggatctgaagggtctgtacgttctcgccatttacattgatcagcgcatccaccggttatggcctcctctgttgtttccgctgctccagcacgctgtgcagcgcttcctggaaccccatcttgggcgcggcggcgccgtctgcgccgcccatccaggcctcggcctcctcggcagtgagcttttccagacaggtgatgctcccctgagtcacccccaggaaataatacgtttcgcccgcgcggaccaggaggagcctttgatcctttcccaccgccacctggtccaaaattgtaagcatccgctttcccaggcggcttggaccgccgccctgtccccgtccggcaacatagcgggtaaacagataggccagcaccaggacgcccagaattgcacagatggtccaaagcacttccggcattggcccgctcccgtcagggattccccaggatggaattgaccgttttcatcaggcggtcctccttgaagggcttgacgataaaatccttgatgccggcctgtaccgcctcgactaccatggcctcctggcccatggcggagcacatcaccacattggccttgttgtccttggcgcggatggccttcagcgcctccagtccgtccatgttcggcatggtgatgtccatcaggaccaaatccggctggagttcaaaatacttttccacagcatccttgccgtccaccgcctcgtgcaggtcggtaaagccattcttggtcagcgtgtcccggatcaccttccgcatgaaggctgcgtcgtcaacaatcagaatcttagccatgttcttaatccccttttttatttcagtctcacttgaagtttgtcaggctccacagttccggcttctggagtacctctgtgatacgcacgccgaagttatcgtcgataaccactacgtctccccgcgcaatgcacaggccgttcacaaagacatccacctggtctccagccagcttgtccagaacaaccagtgagcccttggagaaggttaaaatatcctctaccttccggcgggtccggccaatctctaccgacacctccaggggtacggacataatcagctccaggttttccttctgttcggctcccagcgattccgccgcagcgaaattgggcagcgcgaccggcttgctgttaatgacccgcggctcctgcaccgggggctgatacacaggctgctgataaaccggctggggggaggcggcctgataggcctgggccggctggggagctggctccggcgccggggctgcggacatgctgcccatcagccgttcgatctcctcctgactcatctttccgctggaagacggagccgcggcaggctctggagccggtgtggaaacaccgccgcccatcagacgctcaatttcttcctggctcagcttcccgcctgcgccggaggagggctccggctgtgcgggctgtgcggctggggtggcatccgcctctgcttccccggtgtcctgaatgcccatcccaaagccagccagcagctcccgggccagctccacggacatgatattgacaaactcactcttgaggacgccctctatttccaggataaagtgcaccgccaccagcatcccggtttcgctgtggaagcgctcccttttgatctcctccaaatcatccagcgagaaagactggggcgttgagatattgaccggacgccccagaaaatcggacagagcagtggaggccgcacccatcatctggttcatcagctcgcacaccgcactgatcgtcagctcattgagctcgaactcctcctctgggatctcggttcccatcagcagctctacaattgccttcacatcgctccgcttcagcagcataatattgctgccttccagaccggagacatacttgatttccacgccgatggcgggctccagctcacccagggtaaactcactgatgggtaccactgtaaccttcggcgtcgtaatatcaacgcggtgatccagcaggttggaaaccgcagtggcagaagagcccagactgatgttcatcatttcgccgatggcgtccaattccatcgcgctaaatatattctgcgccatgtcgcttattcgtcccttcttccctcgttatagtagttttccccaatcttcactgccatggagttgttctgcacacccagcttcccaccaaaccatggctttcctccaatatacagatagatgggctcgtccttcggatgtcccaggtcaatgacatcacctatattgaggaaataggcatcttgcagctttacctcggtacggcccagctcggccgtgatctccagcgtggaatcccgcagtatatccatgatttcatccgagttgtcctccccactcccgtgtcctgcctgatttaatgacacaattctggaaaaaatattggtcagcatcattccgggcaggcagacatcaacacggccggagcagtttggaaagcggatattgatcccaacaataacaaccgtctcatccaggccaatgagctgtaccagagtcggattcgtctccactctgcgcagcttgaaatccaacgcgatataattctcccagcttccgcccagaacggaaatcaggtcttttacaatgctttcatagagcctcagctccaaattggtgaaattgtagccggcggggagtcggctgtccacatctccgtcgccgcccatcaggcggtccatcatgctcagcatcagcgtagtggaaaagtggaacagcaccggcgtctcgtccggctgtacctgcccctccagcgctacatctgccagggccaatacgtccccctccaacagcgcgttggaaaactcgtaatagcgctgctcttccacggattccacctctatctcacaggtggtatgcagcagtccgttgattctggagttaatgatcctggtgtaattttcaaagactccgctgagcattttaagccggtctttggtaaacttccttgggctgtagaaatcatatttacggtattttttctcggaactgctctctgccttcgcggccaaatccatctcgccgttacgggccgcgttcagcagagcgtcaatttggctctgagataaaacttccgccatcttcatccctcctcggcagagtttgggccttccccccgtctccctgcacactcaaggattggcagaagtaccggtactttcccgcatggtataatattgtgtaatgttatctccggcctcgtcgtccaggtccagccctgtgacaatcagttccacacgccggttttccgcacgccccgcagaggtgtcgttgctggacacgggacgccactcgccatagcccacgctgaccagccgggccgggtcaattatgtctttttcctgtaggtaaatagtaaccactgtggcacggttggaggccaggaagcggtccgccgtgacgttgttcacctggccgggcacggcctgggcggtatgacccaggacacggatctcgtcgatggagctgctgacctctgaaataatctgggagacttcgtccaatacaaccttgccctcatcccgcagttcgtagctgtctccactaaaaaacacggtgtcgtcaaaggagataaagacgtagccgtttccttcgcccagtgtcacctgattggccattccagcctgttggacatagtcctgcatcgcctggtagagctcctccatgtcctggtcgatatcctcctgggttccggttccctcacccccggacgcggaggggggctgggtttccgtcacctcctcggtggggttaaaggactgtacgagcgcaatccacttttccttgtccagggtagacatggagtagagcatgacaaaaaagcacagcaataaggtcaccatatcgccgtaggtatccatccagttggcaccgccgccgccgctttttttctttttcatcgtgggtaccgcctccctgaagcaagccgcggcttatttctccttgcggcgcttccgctcttttttctctccggtgccgccgccggattctccgccttcccggagtttttggttcataaaggtcatcaggcgctcccgaaggaatttggggttctcgcccgactggatcgccatgatgccttccacgataatctgacggcaaaggatctcctcttcgtcccgggccgtcaggttcgacgcgatggggttgaacaggacatgcgccaacagcgaaccataaaaggtcgtgatcagcgccaccgacatactgggaccaagggtctccatgtcggagtcggagagattcttcagcatgttgatcagtccgatcagggtaccgatcataccgaaggccggggccgcgttggagccccgttcatacatggcgatgacctcctgatggcgctccgaggtctgctcgatatcattttccagaatgttgcgcacccggtccgggtcgttggcgtctacaatgagcatgattgcctgctgaaagaaggggtcctcctgctccttggccttctcctccaaggcaagcaggccgttctttcgggcaatctgcgccagctcggtcagcttctccacatattgttccggattgaacgcgtccagccggagcatgattttgaagtgcttggggaaggacttggccagcttggggtagcaggccaccaccaccgcaagcgtaccgccaagtacgatcaggatactggtgggatctacaaaattgatcagtgtatccagattgaacggaccgaccatgagccctccggtcccgccgggatcgaaggtaattccgaatattacaaatacgaacgccaggacaatgccgagcaaataaacaatgttcatctttggttctcctcccgcacgaagatgcagagcagacacatcactctttataccgctccacgacggctatctcgcggtgaatgtcctgtaccttggcgttatactttgcgatcttctcgatgatttcctcgaccgtgtcccgtacgatgtaatagtcgtgattcatcatgacgattttgctctctggaatcagctcaatgcactcaatttggttgtggttgagcaaaaaacgctcattgttcatttttctcagttcaatcaccgtgccgccctcccctgcccaatccccccacgcctggcggcgtgggggagatcggcaattccatttcttagcgcttcatgttgaccagctcttccagcatggtgtcggtcaccgtaacaatgcgggtatttgcctgatagccccgctggtaaataatcatgttggcaaactcggtggccagatccgtgccggaggcctccaggaagccggtcatcagtgtggcgccgctgccctcagccagtgcggaatcggggtcaaccacgttgtttccgtccgtgatcttgtcatttctcaggtttccggtgacggagtttccaggggtacccacccggatatccccagcggcatcgcccgccgtatagtaggggccctcggtatgaagcacgccattgaggttttccacactgcccagggcgatgtagcccaccaccaccgggtcgccggtgtccttgttggtgccagtgatcttaccgttcttgtcgatgctgatgttctccagatctacaaagccgtccactgtggcagccgggtcattgtctggatatacattcgcaccagtttgattatccacacccacataaaccgcgtcgcccttgctgttcgggtcggtagacttcataggaaggcggatgggaaccaagtcagtgctgggcttatctcccggcgtggttccgggatcatccccgttggaccgcgtgataaatccatagaccacattgccctgtccgtccgtcaaatagccgtcccggaactcaaagttgcccacccgggtcagggttagtcccttgagggcgtccatgctgtcgatatcgtgggtcttatctcccaccaggaaaaagccgtcgccctgaatggcgcagtccatcccccgtccggtggagtccagactctgactgctcatatccaggtcgatggtaccgacgcccacgccatagccgatctgctgggggttggtgccacccaccgtagttgttccggcagaaccggcggactgggtgctgtagatactctctttaaacgtcacccggccgggcttgtagccctgggtattcacgtttgctacgttgttgcccactacgttcagtgcatccatgtgggccttcaggccggaaataccggcactcattgctcctgtcaaagccatttggattcgctctcctttgcgtgctctgattcattgacatttctccggcaccgccgggggacggcccatccggcctcccccaggacatcctttcggtcctgccctctgtgattcacaggatcacggcgccgtcaatgttggtaaagatattctccttcatctcgtcctgggacagggtggtaatcacccggttgtgggggacattgatgataaaggcgaggctctggtccagcgccaggatattcgtcgctcccttggcctgcgcccgctctacggagtcggtcagccggtccagaagggcgggtgtcactgcgatcccgcgctcctccgcccgcgcgatggcgtgcttggaaaaggcgatctgccgctcatctgcccgggccagctcctgctgaagcactgctccaaagccggaagaggtctgtttcccggtgctgtatgtatggccccgtcccagcgcggggctgccgaggccctctaccgcatgctccattccgctctatccctcctttggacggcccctgccgcccgctcaaatcgtccgggcgctctcctccggcggattctctccgccttctcccgttccgtcgccgtcaccgccctcaccgggcccctcgggctcctccggaatctccggcagcttgcccaccgccatgatggaattcaaaggatacatcttgtcattcacgaagatcacgggtaccccctgatagtttccggtgcccgtcacgactccctcaatctcctggagcttcccgtcttcgtcatattggcccaccgtgacggttttccctaccagggaggccgcataggtcagggtgctggcatccaccagggcctccagtccggtcttaacgctggacaacatctgtacggtggacatctgcacaagctggttaagcatttcgccggtatccgtggtgttgtcaatggtctggttctgaagctgctgcaccatcaattggagaaagtcgttaaagtccaggcccatgtcgttctctcccggcttgtttaccggaatgcccagctcctccagctcttcctccgtaatgcgggagctcgcaccactgccggcagcccgcgcgctctgctgtcgggccagactgtccagcgccatcggcataaattcactgctcattgtgtgctactcctttttctgttactccgcttctacgcccagcaagcccagccgaagctgctgcaggaagtcctctgtactctggcgctgccgtccctgttcctgtgggttgcggccgtgctgctgtccgggctgctgctccggctgctgccagggctgctctccctgctggggccggggcacctccacctggatctcgccgctgtggctgccgtgcagcatggataccagcgtcgcggagtgctcctgaagcagcttcatggcctgttcgttctccgcgtggaatacgatgtgcagtacaccgtccttcccctgcgtcagctcgacagacagccttcccagatgctcgggcgccagcttcagctcgacatgcctggctccctcctgctccgcttcggtaatggcctttgccagcctgggtgcaaaatcgggctccgtggcgtccagggtatccgcctcgcccaccttcaccggcatgtgctctgtccggtcaaagagcggctgcgccgccccctccgtctgcacactgtccagctcgggcagctcctgctccccgccggccggacggcccgccgtctctccagcgtccgccggggtctgcgcgccgctctcccgggccgcaggggtaaccgcctgggccgtggctgtaccaccatcctccgcggcaggaaggacctccgcctggaccgtggactccgcctcacccgcaagcgccggctccgccggtaccgggagctgctcccctccggcggtctgctgcccgggctgaagcaatacggccccttcttccgccgcagccggagcttgggccatgccgggaaccgcagtctgcgggacctgctggagggatacgtcgccctctggcgctgcctgggcgcccatcagcaggctccggaacagctcctccagccccggcgcctggggtacggactgcgcaccctggctgagcgcacccccatcggccgcagccggaacctcacccttttggctctccggaaccgcgcgtccggtttccgttccggccgcctccacccgcttctctgccagcagagtggagaagtcccgccggtcaccggcatcctccgtccggccgctgaccggcggagtggtgttttgggcaatctgtgtggctgccaaggtcatctgaagcaataaatcagttgtattcatggttctcacctcctttcaaggtgtggctccgggcggtcaaaccgccgtccggacccgggctgcggtcaccagctcctcaatcagcagttcctcgcccttctgcacctgcttctgatagtcctcccacttcttgtccctgagcttttccagggaggcggtatcctgccgggcggccactacctgcctgcgcttctcctccgctgcggcctcgtactcccgcaggcgcttggcctcccgctggatctcatcctccagaaagcgcaggccgctctcataccgcagggcctcggctatggtcaggccctccgtctccgcctgccggaattccaggttcaggccccggtagcgctcctccgccgcctggagcaccagctcctgctgccgtacctggtaaaggagctgtccatgctcattctgcagctcctccagcacctgctgcttgtagctcaacaccgtattcaggctgaactggaaccgcttcatccctgtcccctcttctcttacaggagcttccgcatggcctccagatcctcctcataggagaacgcctcgtccactccctgggtcaaaaactggttgatcccgtccatctttcccaaagcataatccagccttgggttggtgcccgccttgtacgcgcccacggaaaccagatcggcatttttctcataaatccccatcacgtcccgcacccgggccgcaagccgcttgtgctcgtcggagacgatgtccgccatcaaacgggagatgctggccccaatgtcaatggccggaaaatggttgctgttggccagccgccgggaaagcacgatgtgcccatctagaatgccgcgcaccgtgtccgcgatgggctcattggtgtcgtcgccctccaccaggacggtatagacccctgtgatggagcccttctggaagttgccgctgcgttccagcagcttgggcagctcggcgtagatggatggggtgtagccgcggcttaccggcggctcacccaccgccaggccaatctcccgctgggccatggcaaaccgggtcagcgagtccatcatcagcagcacgtcatacccctggtcccggaagaactccgcgattccggtggccacggaggggcactgcttgcgcagcatggcgggctggtcagaggtagccaccaccaggatagaccgccgcatcccctccggccccagatccttttccatgaattccagcacctcgcggccgcgctcccccaccagggcgatgacgttgatatccgcctttacatttttggcaatcatgcccattagggtactcttgcccacgccggagccggcaaaaatgccgatgcgctgtccctttccgatggtcagcatgctgtcaatggccttgacgccgaactccatccgctcccggatgggagggcgggtcatggggttgatgtagtggttgttctccacacagaacagcgtgccgccctgaaaggggcccttgccgtcgatgggctgccccagtgcattaatcacccgccccttcaggaaggggcccatgcgcaggctgagcctccgcccggtgttgcgcacaaaatttcccgcagagataccgctcatgtctgaatagggcatcagcaggatgtggtcattcttaaagccaaccacctcggccattacctggccgcccgcgtccccgttgtagatctgacagatatcacccacagcggcccgtccgccggatgcctcgatggacatgccgacgatattttcaattttccccgtataactgatcgtctcggcccgctgaatctgccggatcatctcctggaacatggctttgggtcccttccttgcgctgcctccgccctatatctcgtgtatcaggtcgcggatattcttgagctgtgtggaggcgctggcatcaatgatctcatcgggcatctcaatgatgcaggtgcccgcctcatcgtcggacagcggaatgattttgatgtggtcggacaggccggccagagccgtcatcagctccggcgtaatggcagacacctccttggcggcacagccgcccacgtagatgtgcacccactcccgccgcttgagcttttcggtggccacctggatcatccgtgccaccacctcactgctgctgttcaggctgacatggatcaccttttccgcaatggccaggctgagctcacacagctcgccccgcgtctcccgcagcagctcctcccgggcagcggtggccttttccaaaaaagcctgcagctcctcggcctgctgctcccgctgcttctgcagctccgcctggccctcgaccccggcctgccgcagcccttctgcatagccctgccggtagccctcagactgggcctgctggcgcacctgctcggcctcctgctccgcctccatctgccgccggaccaggtagtcctccgcctgccgcctggcatcctccagaatcttctccgcctgaatctgtgcaaagtcgaccgcgctgggggtatccttttcctctgcctctggagctgattcctccggctctccctcttgctcgcccgcggtatccgccggctcctcctccacaagctcctccacgtccggaaacacaaagtcggaggcgttgggctgcaaaaagcgtttgaatatattaggcaataatatcgtcctttccgcccttgaggataatcagctcgtttttctcctccagatcccggatgatccccacgatgcgctgctgggcctcctccacatcgcgcaggcggacgttggtggtgatctccagatcgtctcggatgctctgggccatacgggtggacatattctggaagatcttgttggaaacctcgctgttggcgcccttgagggccagcaccagatccttgggatcgcagtcccgcaggaaacgctgtaccgagcgctcatccatggtgacgatatcttcaaacacgaacatccgcttccggatctcgtcagccagctcggcattatgctcggacagatggtcgaaaatacttttttcactggtgcggtccaggttgttcatcacacccgccacatagtccacaccgcccaccttgacctggttggaagtgagcaggtttgtaaactttttctccatttccgcctcaatgatttttacggcggtcggagacgcactttccatattggcgatgctctccaccacccgtacttgggtattggagtccaattcctccaccacggcggccgccttctccgggtcaatataggagagcaccagcgcaatcgtctgaggccgctcgtgctgcagcgccgcaaacagcgacttgccatccgccttgttgagaaaagagaattcccggttttttaaggacttggttactttttccagcaagttgtctgcggcctgttctccaaacgccttttcgagaaccgcgcgggcgtactccaggccgccttccgttacagctttgttggtcaggcacatctggtagtactcattcaggacgtcttctgtagtggcggcatctacatagcccagcttcgcaacctcgagggtgatctgttccacatcatcgggatccatgtactgatagagctgggatgccttctccgcgccaagagagatcacgacggccgctgccttttgctgtctcgtcaactgttttgcagcttgagaagcggctgcccctccggtagctgtctcgctcattcgccatccccctcacgcagccagctcttgaccatctgagccgcaatctctggattgtcctcggcaaacttccggacatccttccgcagttccatactcttttccgtctgaagattcataatatccgccccctcctgcggcgtgagcggagcggtctccgtctgggccacggcggccagtcccgccgcctccagttctttgcgccgcttccggcggcgccggcctagcaggaggatcaccagcaggagtaccaggaacagtacgccgcctcctgcggccgcgtagatcacccaggccgggattccctccggcaccgggagcacaggctcatccgcctggtagaaggggctgatcaacaccgagatcttgtcccgctgatctgccgtggcgatgcccgctgcccgggcaacgtgaggatacagcgcggccgcatccgtaccgtccgccgccgcctgattgatcgtgacggataccatgacatcgctcactgtgcccgacaggtgctccacctgctgattcgtctcatccaccaggtattttttatctccggagacgtggacgatctggccttccccatccgtctccccgtcctcgttcacatactggttcagatcagcattggtgctcgtaccaggcacgcctccggccgtgtcgccgccgggaaggaggatgtccccctcatagatcttctccccgatgataccctcaccgccggtactgccgtcattggcccagtcctccagattgtaatcggtggagtccgtatagctgcggtccagatccacaatgctgttgacactgactttgacgttctccgtaccgtaaatcggtgtgagtacctgtagcacgctggtgcggattttattattgatctgctcctccaactggagcttcagcgtggacaaatcctggatatccgtaaaggtatcccccgcagaataggtgttcccgtaagagtctgtgatggtgacattgtcaatttccagtccctgaacggagtggctgacaaaattgcggatgccctgcacctgcttttgagtgagctctgctccgtcccgcatggtcacaaaaacggcggcgctggcatcatacttgttttcgctgtccagaatgaaggtgttgtcctcccccggcgtgatatccacgacggcctcctggaccccgtcaaagcaacgaaccaccgccgcaatgcgatcctggagctcatagagctccaactgctcccgttctccctccgtggtcaggctccccacatgatccaaatacatggagtaggcgaagccggacttggggtagccctgctgggccaacgccgccttgagccgtacctcctgctccgccggcaccagaattgtatcgcttccctcaatccggtaatcggccattccctgctcggacagataggacacaatttcatttaattccgtctgattgagcccggtgaacagggtcgtatagggctggttcatctgcatcgccaatacgactgcaacgacagccacgaccgcaatcaggccggctatcaggaagagcttcacctttttcccggccgccttccaccaacctgccaccttgcccaggtatccttttattttctcctgcacacttgttacccccagctccggcaaaccttacacgctgaggcgcataagctcgttataggactccactgccttatttctgagctgaatcaacagttccagcgacgcctgcgcctccgtgatggaagtcatcagcgccgccggattgtccagttggccggtagcgagttgatatgccacctcatttttggccgcgtccgtctcccgtacgcggtcaatggccgactgaaaaatatcagaaaacagggtcggctgggtacgccgggtaccgcccacttccgcgcccgcatccaggcgcatgccctctgtctgcaagtccgtccacagcggctgaatcctatcgattgcttgcacactcatactcgtctctccttcgtgtgtcccgtgcaaaaccgtcccattccctgcggcacaggcttactttccgatctccagtcccttggccacgacctgcttcaggacgttaaatgcagtaatgttggccgacagcgcctgattggccgccatagcgtccgacatctctttgatcaaatccacgttgggcatctccacatacccctccgcatttgcatccgggtgggtcgggtcatacaccagcttaaaatccgagggatcctcggcgatctccaccacacgcacccctccggcctgggcgggagccgccgcgcttccggcgcgggccagcgccaactgaaacggcgtgcgctccccctgctcctccagcaccacaacctttctccgataggggccgcccccctcggtacgggtggtgttgatgttcgttatattttcagagatcacatccaggcgcagcatttccgcagtcagagccgagcctaccacgttcattgaactcataaacgccactttgattcccccttatccccggattgcggtacgcagcagcgacagttcacccgaaatagcactcatgacatactggagctgatagccatttcgcgccagctccaccgactgctccataatatccaccccattgtcgtccatccggacgctctcctgcgcctcgtgaagctgtaccggggtgtctacaattgcctcacgcatggcggcgcccggctggggcttgtccgccgcggcctggaccgcatccctcaggctctcctcaaatgtgacatattgggtcttgtagccgggggtttctgcgttggccagattatttaaaatacagtcctgcttgctccaaagaaatcccatggaccgctgaagcatcagcatggagttgctggtcagaatgttcacaacagcgccttccttccctcttttctgggtggttcctatcaacagccgacttgatccacaacataatgacacattatgttgttaaatcaagctggcttttgaggctgttgtttcaaatgcagaggtactcactcgaagggccctgtaagaatacataaaaggcggctgcaattttcgcaattcttatagttaagaataaacttctgtttttagaaatattgggcttgaagtaaataaaaaaatggtataaaattaaagtcggaatttggcgaaattagtcgagtgcggaacaacataatgtgtcattatgttgttcctgattttggcatgccgcttgatacggaactgtcaggtgaagcgattccaactgttcccggtgttccgccccgctggagacaacgtagatccgggtcgtgttgacattttcatgcccaaggatatccgccagacgcgagatatccttttcttttttataaaaagtacgggcaaacaggtgtcttaggttgtgcggatatactttttccggcccaacttgtgcagatttgcacagccgtttcatggcattccaaatgttgctgcggttcagtgtccgccccccgcgggtaacaaaaattggtccatcctggattccacgctccctggcatagtccagcaaatttcggcacagctcctttggtatcagtatgatacggcttttccccttattgcttgcaattgctcttccaagacgggccgcttccaccgtgatataggcaagttcacttacccgaattccagtcgcacaaattgtctgaatcgccaggtggagccgcatatccccatttcgtcgggctgcctccagcaggcggaagtattcggcctggctcaactcttttttcttatcgcagaaggtctgccgctgtaccttaagcggcttgacgcagcagtccccggccccttggaagcgtaaaaactggttcagtgcaatcagcatggaattggtactgcgcacagcgtaatgctccgccagccaggccttgtattggatcacatcctccttacagacggtctgttttccgtgatacgataaaaagcgtcgaacatcatgagtatatttttggatggtcgcttctctcttttcatccaatataagctgctttctaaacgattccactgcattttccgccaattgataggtctgattcactaatttttgcatactggttttattccctccatttcatttatagtaatacccattttagtcttttcacataatgaaatccagaaagctattattttagatatttcttacactattagtccataaaacgcaaaaggccccccggccatagtgtttccactatggccggggggcctttgaattcttttagaaagtgattgcacgcgcgagcataaccgccatttccgcccgtgaaatcgactgtatgggattcagtttttgttccggcgtaccggtgatgataccatactctatcatatgggacatggcctcctgcgcatagggcgccaccattccgccgtcccggaatccggagagatagccggtattcgctgccccgaggctccagcccgtggcctgcatggtgcgctccagaagcaccatggcatcctgccgggtgacaggctcctggggatggaagcccccgtccggatagccgctggcgatcccggcggcccgtgccgcctggattgcctgggcgtagtagctgcccggcggaacgtcggggaacccggctccgctggccggggtaagctggaacgcccggtagagcatcagcatgaaatccccccggctcaccgcgtcggcggggcggtagcgctggccgccggtaccagtgattacaccggcctcatacagcaggtccacatagggcgcagcccaggcatagctgcccatatcctgaaagtaacgggagcccgatccctgatttacctggatgcggatctgcccacggaaggtctttccacggctgtccgtgccctcatagccaatctggacgctgcctgtgaagcccgctttgggcaggaaagtgagatctgagaggttcggactgccgtccggggtgtactgggtaccggtgcgcacttcggtccccttttcgctgatatcccggtagttgtagtacagccgccccgcgctcccggagggcagggaggtaaagcgcacctcccgcagctcgccctctccgcgtgcggcgcaggcggtacgaaagtcctggctgcggaagggcagcgccgtccccagggtggtatatacaatttcgctggcgccggccggttcttccactgtaatctcgatggtgccctcaaagcgctccccctttgtgttccatccggtaaagccgattttcaccgtgccatagaagttttcgtccggaacgaaggagacccggtccaaataggcgctgctggagcggtagtaattccggctggcggacaccttgctggcgtatttcccgtcatcgtagtcgtagtagagagtgccctcgccggagtccggcagttggaaccgcacatagttcaggtgctctccggtcagtagctccgacaaatcgtcaaagtccccgtccgcgaatgcggcaggctttccatattttgtctgatagcgtatcgttgtgtcgccgctgtccacgccgatgattaccgttccatagaatttctctcccgcggagctccagccggtaaacgggatgtctacggtgccggagaagtccttcttggggacaaatgtaatccggtccacataggggctgctggaacggtagtagttccggctttcggataccttgctgtcgtagctgccgtttctgtaattgtaatacagcgtcccctccgaagcgtccgggagttcaaagcgcacatagttcagcgtagtgccggtcagctcccggcacagggtattgaaatcgccgtcatcaaaggtgatccgtccgttccggtaggtggagtagcgcacatcgccgtcacccgtgcgccccacctccaccgccactgtgccggaaaagcggttgcccttggtgtcccagccggtaaacgggatatgaaccgtgccggaataatccttccccgctacaaatgtaactcgccggagatagggggaggaggaacggtagtagctgcgtccctccgtcacctggctgtcatagctgccattgctggagtagtcgtagtaaagcgcccctttggaggaatccggccgctcaaactgcacgtaatccagggggtagcccgtcacagccttggacaggtcgttaaaatcgtcgtcatcaaaggtcaccttgccgccctgggcaatggtgtaggtgagatccccggtgttctgagcctgagagacgcggatggtaatgcgtccgcggaaggagctcccgttgctgtcatagccggtataggggatcaccacctctccccggtagcctgcggcagccacaaaggtgatgtcggacaggttggggcttccgctgcgcttatactgcttggaggtgtccaccttgctgccgtaattctgctcggagatatagttgtaatagagtgtcccccggccgctgtccggctgggaaaagatgacatagctcaattcccggcccgtgtggctgcggcaaatccggttaaagtcatccgcgttcagtgagaggggctgctgtccggccacggagtaggagacatcctcctgctcctccaccgtgacctcaatcgtcccctggaaaaaggagctcccgctggcatagccggtatagtggatgacggcggttccgctgaaatccggcttcggcacaaaatacagctccgagagggacatctgccccagagacggatcggcataatattgttccccggtgcccacgccctttccggtatctccctcagatttgtactggtagtagagcgtacccttccgggtgtccactgtcagtccgctgatatagcgcagagagcttcccaacacgctgctgcactggttttgcagtctggagcgaagggaggagaaggccagcggctcccccgcccccgccgagccgaaaatgatatcagcggtgttgcgcttgacggcgacggagcaggcggcctggtaattcccgctggcatcggaaactgtaatcaccgcgtcgccctgggccttggcatagaggtagccgtccccggtgaccgtgacgatttccggtttgctgcttgtccacttcaacgtccccagcgagccatacggattcgctttcagcgtgtgggtgtcccgctcgttcatggtcagagaggtttcatccagaaggataccctttactgtgatctcgcaggtgtccgtattgctccccgaaatcgccgtgatgacggccttgccgggggccatgcctttgacttcacccgtagcgctgttcacggtgacaaccgaggggctttcgcttctccaggtcaaaggggccccctccggtgtaaccttggcattgagttggagggtctgcccaatatcaatctccgtaacggcaggcgggtcaatggatattccaggagtgaccgccggtttcaccgtgatctcacagcttgcattgtcgatatcacctgtcccactgttcagataggcagtaatggtaacctttttttcgtcggtcgtttcccctgtttttacggccatcactttggtggtcagggtgcctgttgattccacgcttacccggccaatgtccccgctctcccagcggatcgacagccccgcgcctttcagtccatcctcatcaagcgggcctgtatccgatgttacgatggccttaagcgggagggactcgccctctaccaggtcaatactcgacggctccacctttatgctgtaggtcggcaccggatcagccgaagccaccgccgccgggagcattgtccccaacaaaacacaggaaaggaggagggaaagcacccttgcccccaccttctttttcacggaaaatcactcctttgttctctggaaagcaggggacgggcagggtctgcccgtcccctgctttccaacatgattcgcggctacgtagtgggagaatccccctcaatcgcaccttgcgtaatgacaaaacgtccgtttgtcaggaactgcccggtgccgcctgcctctgtcacataggtcaggattgtttttgtctttgcttccatcccacgtccgttcatgttcatatcgctggcgtaaccggtggtaaagaacaccagcgtgtctccctccacgactccctcatagctgaatgtgaatgtgccgctcggggaggcgagagccccgctcgccagtttcagctttttcgccgcactcccgccgatgccgaaggcctcgtccagaatatagaccgccttcttcttttcagcaggagtggccggagcctttgtccagacctccttgagcgtctgccggtcctcgctgagccaatacagattttcactgaacgaaagtgtcacggttcccgaccagcctgtacccgtggcgttggcctttccacccgttacggtgagaaccggcggatcattatccgggatattgaccccgccgatcgccttaaagccatcctccgtgccgtccttgttccgggcaaccgcgagacagtaatagagtgtattcatgttcatatactgctcaaactgctttacctgcggtacatttttctccaggcttattgggccggaagccaccgttgtcatgctgtcgccggattgattccgccgaatcaatttcccaacacggtcgcggagagatgcctttgcatacatatcaaagacagagggcccttcatttccgcttccctgacgcaccgtttcaatcagcgcctcaaggatagtcatatcctgattcaagccagaactctggaacttctttaaatcttcttggtccatattggcctcagtggcaaattttcctttcagaaaatcggggatctgattatatgccaccagaacataattcagctccgagctctccgaggttttaaattgtacatccgggctctggttgttcaacgtaatatagggcgtccccacatctgtcgtggtaaaccggtaacactgtacctcagaatagttctgcgccgtattctgaatgacaaagtacacgatatagtctgtctgtggagacagatcctccaccgaaagctttaccacgctggactggcatgcagtattgtcatacttgatactgggatttttactgtaactcttctccggattcaaaatatccatgacctgcggctgattgaaagagggcataggaattgtactgttgccttctgtagggaggctggaatagtgaggctcatccttatagtttttgccgtctttgtccgttgtcaggatatcccctttcggtgccactacatagtagaccgtacccggccggttcagcagcagctccatctgtgcatcggtcgcaccaggagtaaacttggggtatccgcttgtaaactccgggatactctggtcgctgaagggcactttcaacgtaaagtctttcggcagcccaatgtctgtgagatcgccgtttaccactgtgtccatccagttttgttccgtcaccgatgtcgccatcatacgcagatcattgtcttttcccgccaccacgttgacgcggatattgacccgtccgttccacgcctgcttgtccctctccccgttcacgctggtaaattccatggcgtactcgtaggtctgtccttccttgagttcgttaagcgggtcaaaatcggtcatcgtttcgcccaccttcaagaaatccttggtcagactgacgcccagaaagccttcagttgcagaggaaagcgtaattgtaacttcgcccttcttgttcaactgctcccacggacctccgccggtgctccgatagaggttaaagctcagattggtatccgtccaaatgagcatatcccaatcaatgaagtcgcctactttatctgtggtcacagggtccagcttccataccgcattaaccgttttcttattatcgggacccgatccgaccgtgatttcagcctggttgacagtggaaatatttacctgggcaaataccgttgtaaacttgtccagagtcaccttacccatgacattcttactctcagaggtatccgcgatctttccggcctcaatctcaaagtaataagtcgcaccgctctggaggttgagggcggcatcggcacttccgcccgaacccgggaacacgaccaccgtcttgccatcctcctgcttgatcaccacattctcgtaattgatcgtccagttgtccttgtcatccttgtaatccacaacctgagtggccgggccgtttccggtgtcctggtagagcttaatgctgtcccgcagcagcccggccagctttgacttcggctcggtgccagccgccaccttctgatagagctcatacaggttctggttcgtccccgcgtcctgaatcccctcgctgaacaccagccggacatcggtattgggcagtggggtagtggagtcggttccgttatacttggtgaactcctgggttacagtgggcgcattgggatccagcgtatgaatcgtaatctttcccaccgtctccgagtagtttcccgccttatcctgggccacataatagaggtcataagcagtttctttctccaggccgctgacggtaaaggagacgtccttcccctcggtcatggtaacctttccgttcttgagtgcgttcataccggccgacacctggagtttggcgttgtcgctgctcaaatccacctttccggactgtccggccaggggcttggggtactcctccccctccttcaccaccacccagtacagagtgcccgcctcgttcaggttggcatacagccccacagaggtggcattcaccttatttactgtagggttggtattgaagcggggcggtgtaccgtctacggtggtaaaggacacctttttgacggcggaactctgcccaccgtccacgtcggtgagccacaggtacaggtcgtaggactccagctcctccagagggacgttgttcacgtcaaatgtattggagacgttcttggtcacatcgagggttccaaagcccagattgccgctgacggcgttggccttaaagtcgttggccgtgggggcggacgcccccttgggcagcaccgcccagtacagccggcaggacttggtggccatggtcgtcacctgcccggaggtgctggtgattttggacatataggggtaaccggaggcgaaattgggcacggtgttgtccggcgtagtaaaggagatgaccttcagcgggctccgctcctcccgcgcgtccacaaagacggcggacaggtaataggagccgtcggaggtcaggccgctgattttgacgctgcccggctggctggagccggtcaggctcagggtgccgctcttgacaatcttggggctgtaggacgaggggttgagcaaatcgtccacccccacggagccgtcggtcaccgaggtgaccgcccaatagacggtacccttcttattggcgctgaaccgggcggtggcgctggtgggcgccagatccgtgacctccgggtagcccgccagcagcctcgggtccgccgaggactccgccgccgcttcactgcccatcttctccccgtcaatggtggcctccacgccgggccggatggtgatttgatccggcaacatcgtcaccgtgctgcccggggcgttgacggtcaggtggccgatgtccccgtcgccggtcacggaggtggccacgtccaggttcacgttgtccacctcagcgcccgaggcaatgttcagagtcgaatccgtagctttttcgtccacgttaatggtatccacatgtccgctggcgacgccaatgctggacttgggcgtcaggttcgtgacctccttgacattgcccgccaggttgagggaaaggccgtcctccccctccagggcgatcctgctcaggccgtaccccgcgggggtgcggtcgtccagataggcgtcggtgcgcacgctggtatgttcaatgaccccgtcgccctccacgcggatggaaatctgctggttggggatgttgtccacaatcagcttgggcgcgttcacattgcgcagcacaatgctgtcgtctccgccctcgctcacgccgccgccgctgatgacgatctcccccagcacggtcacattctccagcgtgatctcgcccagatccacgccgcccgttatgtagaggttgccgcccaccacggtatccctcagggtgacgccggagctcgtaatggttacattgccccaggtgctccccaggctgtggactccggctgtctgcaccggggtgcccacggcctttaccaccaggatcgccgcctctccgcgggtaatctggttcttggggcggaagctgccgtccgggtagccgttcaccaggccgtaccgggctgccgtggcaatatagccccggctccactcactcagctcccggctgtcggtaaagctggtgttctcgccggtatccggctgcagcatcagatttcgggtgaggataatggccgcctcctcccgggtaatgctgctgtcgggggaaaaggtggtcttggacgtgccggaaatatagccctccgtataggcgatatccacatcctccgcataccaggcggaatccggcacatcctggaagggatcgccccccagcttctcatagcccagcgcccggttgatcaccgtcacaaactctgcccgcgaaatggggttgtccggtcggaggttccccgatatatccccccgcataaagccccaatccaccatctgctgcaaataggagtctgtataggctgccccggcctggcgaggcagttgcgggagcagccccagcagcaggacgcatgccagcagggtggcgcctacacggcgcacagttcccttccagaggttcatcatcgtttcgccatcctttctcttgctctgcttacatttctgccgtatgccggaactgaaggctgaacacggcctcacagaccatattttcttcctcacggagcatatcaacaaactccgccgcatagagaggaatcggctccggagagggccgctcgcgtaaaatctttaccctgagtaccagcggctctgctgtaaccgggattacaatctcggctacctcgtccacctccagcttccgggcgcagaaaaaggccactccgccgcagctcagatcgttgctcaataccggcatccgcccgcgccaccggccgctcaccggatagaggaagctctcaaaccgcaccggcatgcgcaggttgcggcgcacctcctcccccagcatgcgcaccgactctaccgagacgagattatcccggcaccggacaatccgcccttccatcgccgggaactgctccgaggttcccaccaggctgatgtactcatgccccagcacccgcttgatatccccgtgggcgatccggagctgccaaacgtttttttccggtccatcctcggaaaccccctgggccaccggggctccccggctgtccagcagcatgtatttatagctcatcgcatactcactcctttgcctgcttcgcctccagccgttcccggcgctcccggcggtatttctccgggtccgacgggtcgaactgcaaaaagtaaatataaatgtccacgatggcctgatagagctcctccggaatctccctgcccagctccatctgggacagaatggtcgccagggaattgtcctcatagacgggaacgccgctgtccaccgccacttctacaatccgctcggccaggtggcccatgccggacgccacaatcaccggcgcaccactgcccggaccatattgcagggccaccgcgcgcccggagccgccctgtttagattttgacattgataccgcgctccccttcaaacagtcccggaaatacttccgtcagcgtcagcggacgggtgtgcttctgtacctggacacttctccccttcaggccgtggtcggccagaatctgccctaaatcctccgcaatcaggctgctgtgggctgtcacactgtccgggccgtagacactcacatccacctgctcctttccggcccccagtgtcatctccaaaaagcccactgaggggagatccatcttgaacaggaactggatcttatgtccgtccccgcgcccatcccgggcctcctcccgctcctccgcgtccgggtccacccataactccgagtacatccgcctgccctcccactccagcgggacaatggtatggtgcagcgggaggaatacgctctcattgagcagcatggaccgcacgatctcctgaaacgcctcccgcaggtccgtgccgtattctccctgcagcgcccgctgcgccgtccgggccagctgctccgtaaatgtatccgcctgggcggccttggtaaactggttctcccggagcagcttccacagcgtctgatcgtccaactgattgagaccggccagggtatctccatagccgcccaactgccggaacgccagcatgaccccctcctccgcgccgttttcatagcgggccatatgcagcatcagcatcccaagcagcgtccgtgctgttcccatatcgtgataacgcttgatataagaacccaggtagggcagaatctgtccctgcagcagctctaaattctccgcccgcgccccggcctgaaggccgttttccagcttccccgtcagctcagccaactgtcccctccaactctggggcagatagtccgaaagctgccggagcagggagagcatgctgcgtccaatgtgacccgtggcggaaaaatcactgtagcgtttggcaaagttcagaattgccccccgcacggtatcgccgggcgtcttttgataaacctccctcagcagggagaagaggggccctgcaaatcggttgcccgcctccatctgcgtctgaaaaaactgtcggaacgcatcggggtccattttaagcagttccagaaatccggataactcttctgtcacacctgccgccaagccgggcgtggttaccaatccctgcatcagtgtgaccagcttggacagttccgcccccaattccggcatatcccgcatctgctgcaggaaaaactgaaggttggaatcatagcgcagcacaccggagttcagcgcatcattggccccctgctgatcggtacgggcgtccggccggcccacccggctggggtccgggatgttctgaatccgggtgtcacttggctttggggctgccggcagtgtgcggttgttatttgaggcgtcataattgggaaccggattggtcacgcccactaaattcgccacgtgcaaatcacccttttctaaaatctcattcctggagagggtggcaatgcggccggattccactccatgtatctttttcgcgttctgctcttattttttggccaatcctgtcgatcggaacatcagaagttcaacgcaaaggaaggatgtaccgatgggcaatggaaacgacagcattttagaggcataccttttcgaaaccaattccctgctggagcagcttgacagccttgttttggccgccgaggaaaaggacagcttttccgaagaggatgtcaacacgatcttccgcatcatgcacaccatcaagggctcttcagccatgatggaatacagttccctgatgacaatcgcacaccgggcggaggatctgtttgccattgtccgtgacaaatcgatggagattgtcccggaggcgctgcgccccgccctgttcgacctgctgttccagatcatcgactttttccgcggggaaattgagcgcattgaaaacggacaacctctcactcagacgatcgacagtcttctccaaaaagttaatagttttattcagcaaattcaaaatggcgccgccgctgcgccggccgaggttccgccggccgcgccggaggcgccggccccggcggattccggtccggcagccgtccccggcttcccctatgctctccagatcttctttgacgagggtgccggcatggagaacctgcgggcatttatgcttgtgagcacaatccgcgacggcggctccgaggatagcttccaataccttcccgccgatgtggagcacaatcccgacaccgcggcgcagatcgtggactccggctttacgctctatttccgggatcaggcacagcgggatgctgcaatccatgcagtcacgaacgccggctctgtgcgtacctaccaggccatcgatcaggaggcgcccccacccgtcgccccggaacatcagtcccccccggcggaaaagccggcggccccggcttcctcccgggaggcccccaaggccgagtctgcaccccagcctcaccgcgagagcctgatcagcgtcaacctgagcaagttggatcagctctccgcagtggtgggcgagattgtcatcaccgaatccatggtcacctcctcccctgaactgaagggtcttcgcctggatgagtttaccaaatctgcccggcagctgcgcaagctcacggatgagcttcaggatgtgtccatgtccctgcgcatggtccccgtgtccgccaccttccagaaaatgcaccgcatcgtgcgggatatgtgcaaaaagctcaacaagcaggccaggctcacactggtgggcgaggagacggaaattgacaagaccattgtggacagcatcggcgaccccatcatgcacattgtccgcaactccatggaccatggtatcgaggaggatgtccaggaccgcatccgtgcgggcaaggaccccgttggtgagattactctctccgcccggcagaccggcagcgaggttatcattgagatcagggatgacggccagggcgtcaacgatgaggccgtattgcgcaaggccgtcaaaaacgggcttgcctcccccgatgtggagtacagccaccgtgaaatcctcaactttctcatgtctcccggcttctccaccaataccgaggtgacagagttttccggccggggtgtcggcatggatgtcgtcaagcagaacgtggaagcggtaggcggaactgtttctctcaccagcgagcttggcaaaggcatgaccaccacgttgaaaatcccgctgaccacggcaattatggacggtatggaggtatctgtcggaggctcgattttcaccatcccgatccacaatatccgccagtccttcaaaattcactccgatcaactggtacacgacgctgccggcggagagatcttcaagtgtatgggcagcttttatcctgtggtgcgcatgcgggagctctatcagatcgaggagggatgcacccaggtagaggacggcatcctgatctggctggaggccggtgaactctcctactgcctgtttgtagatgagctgctgggcgaacagcaggtcgtggtcaagcccctgcccagctacctaaacagcttcaacatcaagcgcagcggcatcgcggggtgcacgattctgggggatggcaacatcagcattattctggatgtggccaatctctactctccctttcgttaaggaggcattataaccatggatcaggataaccaattcaacgccgtaccggaggagggcgtacctgccccggcactggatgcccagacggtgaagtatctgctcttctgctcggacaacctgctcttcggcgtgtcggcagattacgtggtggagattattaccaaccacgccattaccaagctgcccctggtaccaaattacatccggggaatcatcaacctgcggggacagatcatcccgatcgtagacatccgcctgctgctgggacagcccagtcagagtgacaactgtatcatcattctcaacattgaggacaccttggtaggtattctggtggacactgtgcagaagatgattgatgtggatacagcactgattctgccctctccctctcaggacacccggaatctggtttccggcatgtgttctctgtccgaggaacagaccatgctggtctttgactgtcctcaaattctcaaccagccttagggcagaaagtgcaggctcctgttttgaatatgctgtttcgcgatatgtccgtttcagacgctgattttcagcgcatggtgcgctttattcaggataactacgggattgacctgagtaaaaaaaagcagttgattaccagccgtctttcccattcccttcgggagcgcgggtatccggacttctctgcctttctggaccacctgctcaaaaagcaggaccccgctgatctggagctggtactcaataagctgaccacgaattataccttttttatgcgggaacccgaccattttacctttttccgcgatgtgatactgccggagctctcccgccgccatcagaaagaccgggttctctccatctggagcgcgggctgctccagtggtgaggagccctatacgctctccatctacctgaaagagttttttgggccccaggcatcccagtgggacacccggattctggccactgacatctctcagcaggccctgtccaaggccaaggcggggcagtacaagctgcccgctgatatgcccggtgaatggctcaagcgctattttgtaaaggatgacgccacctgtctctatacggcggcgccccaactgaagcagaatgttatttttcgcacgttcaacttgatggaccccattcacttccggctgaaatttgatgtaattttctgccgcaacgtgatgatttattttgatcaggcgacccgggacgccctggtccggcgcttttacgatgccctgcatccaaccggatacctgtttatcagtcactccgaatctctggggcagacccggctgttccgaacggccgctccggcggtttatcaaaagcttccactcgggacgcaccagtaaatctcgcaaagaaaggttccggtacttatgcagaccacaaatcgaaagatccgcgttttggtcgtggacgattccgctgtggcacgcagcgtcatcatccaggggctttccgcctcaccccgcatcgaggtggtggggtatgcagtcaatgccatggatgcaaagacaaaactccagcacctctcccctgatgtaatgacgctggatgtggaaatgcccggcatcaacggcattgattttttaaagcaatttcttccgtcacatcctctccccgtcatcctcgtctcctcccttaacctgcgggtctttgatgcgctggccgcgggagcggtggactttgtgcgcaagcctgacgcggtagagagccgggaatccttcctccaggccctgacccataaaattattgtggcctcccatgccaggttatcccgtgccaacctgccccaccctgccgcccccgccgctccgctacgttttggcggcgatggggcgccggagcagaccgttatcggtctgggcgcctccacaggcggcacagaggccacgctgaacgtgctcaggcggctcccggccaacattcccggcatggtgatcgtacagcacatgccggtcgggttcaccaagatgtatgccgagcgcctcaaccgtctatgccaaatggaagtgcgtgaggctgtcaacggcgatgaaatccgccctggcctggcacttgtggcgcctgcggattatcaggccaaggttgtgcgcatgggcccgcgctacacactctcctgtattccgggcgaaaaggtgagcgggcaccggccctcggtggatgtcctcttttcctcgatggccgcctcggtccgctgccgcatggttggtatcatcatgacggggatgggccgggatggggccagcggcctgctggagatgcggaaggccggggcgtacacgatcggccaggataaggactcctgcgtagtctacggcatgccaatggtggcccatgatattggagcagtcacggttcaggcctcctgcgacaacatcgccagtgttctgatgaaccacctcaataaccgctgatgatttcagtaaaaggatcgcttcctgtactggctgtgcaaaggcaggcgcaggaagagaagggataagtgtcaaacgagtttcgtgggcccaatcaattggccagcagtctgtgtttggcgcctatcctttttcttttggattggtgaaataggttcttatatttaggggggtaatctatcatgaggagcatcaaacaaaagctcttggtccgcattttggcaatgaccgcagcagcggccctgatttgcggcggcgtaggaattgcagccaactacatcagctcccattcgatgctggagcaaagcctggagtccaccgcatccctcgccgccacccgtgtttcctacgagctgttgtcctatcaaaacgcggttcgcggcctgggtatggttccagagctcagcgacggcgccgttcccgtcactgaaaaggagcggattgtagaccactgggctcagtcttatggtatggagcgcggcaatttgctggatttgtcgggcaggagcctgtttgacggaaacagctactccgaccgcgcgtatttccagcaggcggttcagggggaggtctgtatctccgtgccaaccctgagcaaagttacaggggaattgtccatcatggtggccgcgcctgtctggttgaacggcatagagggcggcactgtcgccggtgtagtctactttgtgccccatgaaaccttcctcaatgacatcatggagtccattcatatcagcgaaaacagcggcgcgtacatgattgactccactggtacgacgattgcggacaccacgctggacacagtatcggttcagaacattgagcaggaggcccaacaggattcctccctctccgccctggcggcgctgcacgcggacatgcgggcggggaacagcggctacggcagctatgagataagcggcgcccagaaatatctggcctacgccccggttccccagaccgacggctggaccgtcgctgtcaccgcgcccgttaaggattttctgggcaccacctatacaagcacacttctgaccgccattcttttaattgtcatcctggtcattgccatcctcctggcggttcgaatggcgggcgagatcggcaatccgatccgggcctgcgccgagcgccttcagcttctggagcagggagacctgtcctcccctgtccccacttacgagcgcagagatgagatcggcgtcctttcgctcactacccggcagatcaccacgcggcttcaggagctgatcggtgatattggctacctgttgggggagatggccgacgggaactttgatgtccgttcgagggattatgacctctaccagggcgactatacgaatatcctggcctccgtgcgcaacatcaaccgcaacctcagtcacacgcttcagcaaatcaatctggccgcggaccaggtttccgccggcgccgagcaggtatcctccggcgcgcaggcgctcgcacagggcgccacggagcaggccagcgcggtggaggagctctccgctaccatatccgagatcgacagcacagcccgggaaaatgccgaggcctccacccaggtcaaggaaaagtccggcctggctggcgaaaaggtgactgtgagccatgaaaagatgtctgcgctgacggatgccatgtccgatattctgaaggggcaccaggagatcagccaaatcattgaaacaattgaaaatattgcgtttcagacaaatatcctggctctgaatgccgcggtggaggccgcccgggccggctccagcggaaagggcttcgcagtcgtggccgacgaagtgcgcaatctggccgccaaatcggaccacgccgccaagcagaccaaggagatgatcgagcgctccaccaaacatgtggagcggggcggccagttgactggggaggtcagcgcggttctggaagagaccacccgtctggttcaggataccgtcgctttcattgaccaggtggccggcaacattgtctcggaggcccactccattgaccaggtatccgagggcgttgaccagatctccagtgtggtacagacgaattccgccacagcagaggagagcgctgcggccagcgaggagctctcggggcaggctcagctgctaaaggagctgaccgggggattcaccttccgcaaggacgataccggtactgctcagcctccgcagtaaccatatgggaccttccgccgtaaagcagacttcccaaagcccaggcgtccccgcaacaaaaaagctgcatggaattgaattccatgcagcttttttgttgcctattttcttatccgtgcagtgaacggccgttcagcgctccgttttcccttgctgttcccccaccatgtgccggtatgccttcatccgcgcttcgctgatccgtccggcacagaccggacagccgcactttcgttttccagccctggagtagacgaccgccttccacacatgtccctccgggcactgccaccagacctttctccggctcccagccgtcaccattctgggcgtcaactggccgttcagcgtcgggtgccactgggcggcgaccttcggctccacggtctccaggtcgttaaagccgggccagaccttccgcccggcgcagaagggacaccccgccccctccctgctcctggaggtcaccgtggccttccacgcgtggcccaggggacagagccaccagacctttcgattgctgttgggtgagacattctccggcctcagggcgccgtttttgtccggatgccattgagcggccagttggggaaactggctggccaaatcgttttctcccggaatgatctgcttgccggcacagaccgggcagccgtttcccagactggttcgtgacagcacactggcctgccattcatggcctttgtcgcagcgccaccataccttgcgtctggtaccagccgtaaggtctccgggggtcaggcttccgttccgggttggatgccactgggcggccagctcagggcgcagggttgccaggtcgttttccccttccgccagcttacggttggcgcagaccggacagccgcagccgtttacccttgtctttacctccgcctgccactcatggcccttctcgcagcgccaccacaccttccggtggctgccggggagcacctcgctcggggtgagcgctccgtttctggtcgggtgccactgggcggccagctccggccatagcgtggcaaaatccgtctctcccggccacgccatgacgcccctgcaaaaggggcagcctgtgtggttgctggtcctgctcgtcacttctgcctgccactcatggcctttcccacagcgccaccacaccttctttttacttccatagctcaccgtctcaggggtaagcgctccgtttcgctcagaattccactgccggagcagctccagctccccggttcgtttacagtagtcgaacagtgtttcgcgcatggtgtactcctccgttagcgcggcagcgggcaaagggagtgaaaacggtttccgcagaagccgccccgccgccgcgggcgtccccggccgttgcccaggggcccaccgcctcagccgcccttaacgtggcgggcaacccgcttgtcctcggtgcggatatgtgtaatcagtgtgcccaccagagtgttgagggtatgcagggatttcacactgggcccctccgcgccgatctggttggccgccgcagccaattcgcgcttatacccctcgtggaaggtgtggtgggcgttgtagccggggtatttgctttgaagctggagctgctcctcatcgcggaaatgcttgctgacatagctgttcagaaactgcacggtttcattgatcttggtgcgtccggccccctgggcacaggcgtccagcagggcgttgatggcgtcaaaaagctgtctgtgctcactgtcaatcaactggttgccggtcagcaggtcctgagtcaattcataacgcataggtacaatcttcctttccagtaaatcaaatccatatagaactagaggatattctctatatttttaaatcgtccatccgtttcaaaaattaaccccttccagacaaattccgcggttccaaaaattttttcaaaaaggacttaataattccagctttgcaccgatcaaacagatagtgcgacgcactggagggcggcgtcctcagtccaaaccgccgccctccctcctccaaatttcaaacaggctgtcccgggcggggctgccctgtctgaaatagattccgggtctgcgcggcctgcccggccggctacgggctgcgccacccaccacccctgcggcccgggaggaaggaacctcccggagaacaatgttaaggagagtaagacatcatgcgtattcagcacaatattatggcgatgaatgcctaccgcaactacgccaacaacacatcttctctgtccaagaacctggagaagctgtcctccggctacaagatcaaccgcgccggtgacgacgccgcgggcctcgccatctccgagaagatgcgcgcccagatcaccggcctggacaaggcccaggacaacgccaaggacggcatctccctggtgcagaccgccgagggcgccctgaccgaggtccacgacatgctcaaccgcatgtatgagctggccgagcagtccgccaacggcacctttgaggacggcaccgaccgcaagcagctccagaaggaggtcgatcagctcaagagcgagatcaaccgtatcgccgattccgccaacttcaatggcatcaagctgctggacggctctatgtccgctaccgcagttacaaaaattactggtgcagctactaacaacaaggccggcgtggacgtaagcattatggccgattctgtaatcgacagcactggaaagcgtactaatttgaagttcaagcttgccgcagatactaccggtaaggctggcgtcaaggtcgcaaaggatggcactgtaacaatcactgtcgcgaacaaggataaggacggtcatactgccgctgatatccaagcgctgctggcaaaggctgtggccagtggtgctggagtcagtgatgatatgctgagcgctgtgcagaatgccacggttactggtgctggtatctctgttcccactagtactgctaatgcgtctacgtgggcatctctggcacaaggcactggtaccacaactcccaataccggtaagcccctgaccctgcagatcggcgatacctccgacagcttcaatcagttgcgggttggcatcaagaactgccatgtggacgctctgggcctcaccgatatgaagattggcgatcaggacagcgctgccaaggctctggacaagatcaagagcgccatcaactatgtctctgatgtccgcggtactctgggcgccacccagaaccgcctggaccacaccatcaacaacctgtccgtcatgcaggagaacatccaggacgccgagtccaccatccgcgacaccgacgtggccgacgagatgatggcctacaccaagaacaacatcctgatccagtccgcccaggctatgctggcccaggccaaccaagtgccccagggcgtgctgcagctgctccagtaagctctggtgttggctgagcatctgcacgctcccgacccctcctgtgctgccccgccctggggcacgggtagcccccgccgaagcccagcgaagcgggttcggtggggagaggaggcgcgacggagagagcaagctttgccgcctgcggcgaagcgagggattcgaagtccgcgccgacgaagggcgtgctgcagctgctgcagtaatccggagcagttgttctttcacagcaaccacaagggggccgggcactgcgcccggcccccgtttttctatgctgagacagggaggaactatgacaaaggaacaaaccgccttggacatcgcccgccggatggcggagctgggagagcggagccacgctgtgacggcctataccctggctatggcggacgcccgggaccgccagccggagacagagctggaggccgccctttacctgtttgaaaacggcgggaactacaaggtggcctatgacgccttccgctccctctaccgccggggcttccagcgggaaactctgctggagctgatgacccaggctttttaccagcccaacatcaaactcctgaagagccgatacgagaagaactgccgcctgctgcgcaaatatccctactgcttccagcaggactttcccgcctttgaggagctgcccctccgcttttacccctacgacgaccagcgctacatcccctttaccgtagagacggagaccttcggggagcctttggacctccggcacccggtgatcagccgaaacttcttccaaaacctggacaagcccgtactggcggcggatgtgtactcccagtatgagctggagtacctccgggacaatgtgcggaaaagcgagtgggtgggccgggagaaccacgtctatctccattacacggactgggggatcttctgcgcctatctccaggtcctgaacctgcggcccctgctggcggaggagaagctggtcttcctgatcggagacgagatcagccagtaccccatcgacttccagacccggttcggcatggattacagccagtatcccgtcaagcccgtcggcatccgggagatccaccggctgatctggcacacccagctctccagccataacggaggcgactttttcaacgagatttttgacaaccatcccaacctgattgcggtggagtcagaaatgctctaccatctgcgggatcaggtatcgaagttccgacagctcctcagcagcggcggaacgatcacctttgacagcgtcatcggtgacggggatctggagaagccccagcggctggcgaatcagctcagccgtctgcacaatcggacggacaaggatatcttcgtggccctgtatctggctatggcggatctgcggaacctggaccccgctgcccgaatcgttccatctatttttttccaaccccactttcacaactaccactgcactctgggcgcgaacgaccagaaccgggcggtgctggactcggcggagtaccaggagctgcgggacttctcccccctcaagggcttcaagtatatcaaaacgtttacacccctgcgccgtcccaccacttctgctggtgcggccgtgagatacatgcaacgacagatagatgcctgggagccggagcagaaggcggtgaccatgccagatgagcttgctgaccgggtcctgaaccggaactacatggtggactggcaggaccggctgtttcaggattcggtgctggtccgctttgaggacggcaagctgaatccgaaagccacctttaccgccctggcagcctttttggacctaccctatacgaagagcatgacctactgttcccgcaacggcgagcgggacccggagtctttgaagggaaatgaccggggctttgacccggcggccatctaccggacctatgaggagtatctgggccgggaggagcgggtgtatctggagtatctgatgggagacgtataccggcgctacggctatgattttcagtgttacgacggcgcgcccatggacgaagaggcgatgaacgcgctggtcggcaggctgcacggctgcacggacctgatcctggcctcctataaaaaggcaatggagcacaaggtgtttttcgagggggaggacccggaacagcggcggcaggagatcttgaccgagatcggggaaaacatggcggccaagcggcgggagatcgcaggcgttttgatgcgggggctgcggttcgtcaacaaaaacggcgcgccgctgaacttcatgccccttttggagctggacccggcgctgctggaacagccgctgtatcactgaggaggaggacatggaacacaagggaaccgtatattttttcaccggcctgtctggggcggggaagacgaccgtgggcagcctgttctaccagcggctcaaaaacaccaagcccaatgcggtctatctggatggggacgaaatccgggtggccttcggcgaggatgtgggctacaccaacgatgagcgcctgcgctgggcgggccggatcttccgggtgtgcaagctgctctccgaccagggtatcgacgtggtgtgctgctccatcgccatgtttgacactgtgcgccgctggaaccgggagcatattccaaattacaaggaaatctatatccgggtcaaaaaagagaccctcatccagcgcaaccagaagggcctctataccggggggcgcaatgtggtgggggtggatctgccctttgacgagccccaaagccccgaccttgtgctccagaatgacggggagcgcactccgctggagctggtagaggagatcgagggggcgctctacccgaatatcgtggagcaccccatcgacaataccgattactggaacctgtattatcaaaacaagctctgtcccaccagcccctcccccttcgcccggtatgtgtccaccctggtggagccggggcggacgctggcggagctggggtgcggcaacgggcgggacgccctctactttgcctctctggggctggacgtggtggcgatggacctgtctgaggcggccatcagcatgctccggcagcagccggtcccacacgcccggttcgtatgcggcgacttcgtcagccacaccctccaccagccggagagctatgactacgcctacagccgctttaccatccacgccatcaaccagaagcaggagcggatgctcctggggagcatggcccgggccctcaagccgggcggaaagttcttcatcgaggtgcgcagcgtccatgacccgctgtacggcaagggggaggcgctggagcgcaacgcctttttctacgacaaccactaccgccgttttcttgtgctggacgagctgaccgaggccctccggcaggccggcttccgcatcgagtacgccagggaacagaccggcttcgccccctacggcaacgacgatccccccgtcatccgcgttgtggcggtgaagaattgaggaggcggtttttatgacctgtccggcggatctgcatacccataccaccgcgtcagacgggcagtataccccgtcccaactggccgccaaggccctggcggccggaattcagattctggcagtcaccgatcacgacaccatggacggcgcggaggaggccgtccgggcgggacaagcctgcggattgacggtgctccgcggggtggagctgggggcccgggaggaccgtcacatgcacatactcggcctcaatctgggccccgagtgtcccgccctggcggagctctgccgcaggctccgcgccagccgggaggagcggaaataccgcatcgccgcgtttctccgcgggaaggggctggacgtgccgctggaggaggtggaggccctcgccggcggcggagtggtcgcccgcccccacttcgcccgggtgatgctccggcgcgggtatgtctcctccctccgggaggccttcgaccgctatctggacacggacgaataccagcgcattgagcggtggaaggccggcgccccggaatgcatcgcggccatccatgacgcgggtggaaaggcggttctggcccatccctgccagctcggctgctcccacgggcacctggaggaaatcctccgtgcactgaaggacgcggggctggatgggattgagtgcttttatccccggcattcccccgaacagaccgccgcctatctgcgtcttgcagacaaatacggcctccatatcacggggggcagcgattttcacggggaggccgtccgaccagattccttccttacccccattcccctcaacctcaactggctgggaaccttccaaaatgcccagccacatcggaacaggctctatcaaagccaaattccgcacttccgataggttttcgttgtttttccccttaattttttatttatccgtccgatataaacatcagaaaacgattacatacaatcgttgactgtgtgtttgacagagaggaacttcccggcaaagcggcagacgctgccgccggtttgagataaacatacaaatacttggtatcacgcccataacgcagcattttgcaatgataccgaatgggggaatcgatgttgtttgggaaactgaaactgacttctaagctggcggtcatcatcggggccgtcctggccgtcatctttgcacttctgatcggagtgacgatctccactaccagcaccagcatacagaagggcattgcaggcgagctgtccgccctggcgaggacaaccggcacagagatccaggacagctttggggttgtggatgatacggcccggggtatccaggaatacatcggccgcatttacgccaaaccaaatggcgctcccggggacgccgctgccatgcagcagagcaccctttatccgggcctgtccctgacctccaacgcatacgatatggagcagtttattgtggagacggttcggaacgcggtcaaaaacaaccccgagctggagggcatcggcgtcatgtttgagcccaatcagttccagagcaacctccggcactatgggttttatatcgacatgtcctcggccgatgccgaggttgatgcctatgcctcctacgaggaatatgccaaagaggactcctaccgggtccccgcccaggaaaaccggatttacatttccgccccctatcgggatggagatctgctgcttatcgcctacggcactccaattgtttacaacggttctgtgattggtgtggtcatctccgtcatcgacctcagttccttctcttccctccagatttccgacaacaattacacctccatgtggtctaccctttacagcggtgatggaaccatcatatgggacagcgaaacactggacgatgtgggacacaacatggtggagtttacaccccaggccgacgagctggaggccattcaggccgccatggcccagggggatgcgttcaatatgcgcaagacccgcgaggacggcgaccaggtctcctgcttctacagccccttgcaggtgggcggtgaaacctggtggtccatgaccggtgtgtatacctcggacgccctgtcctccgtcacccggaccacacgcctgctgcttattttgtcggtggcatcgctgctggtgcttcttctggttgtgaccgccgtcctccggaaaatgctggttcctatccgtgctgtggtgtccgctgctgacgagatcgcctccggtaacctggacgtacacctggacatccgctctcaggatgaaatcgggcagctcgcccagtccttccaggctatgacggaaaacctgcgggcgatcattcaggatatcagttatctgctgaatgagatgagtgacggaaacttccgaatccgctcgaaggatcgtgagcgctatattggggactacaaccaaattctgctttccattcgccgcatcaactataccctcagcgacaccctcagccagatcaacaatgcggcggatcacgtctcctccgggtcggaacaggttgccagcggagcacaggcgcttgcccagggggccactgaacaggcctctgcggttgaggagctggctgccactacctcggatattctgaaccatgttcaaaagagcgcggagcacgcccgtgatgccagtgataaggccgccatggtcagccaggagattgcagagagcaatcagaaaatgcaggaaacgctgtccgccatgcaggacattcaaagcagctccaacgagattggaaagatcatcaagaccattgaggatattgcgttccagacgaatattctcgcattgaacgcagcagtggaggccgcgcgggccggggccgccgggaagggatttgctgttgtggctgaggaggtgcgcagccttgcgcagaagtcctccgacgcctcaaagaataccgccgccctgattcagcgttccctgtccgccattcagaggggtacctccagtatgaatgagaccgcctcctatctggaaaatgtggtgggccgtgcccaggacatcacggctacgatccaccagatttctgacgcctctgaacagcaggcggacgcccttgagcagatcaacgtgggcgtggagcaaatctccagcgttgtgcagaccaactccgcctctgcggaagagagcgccgctgccagtcaggagctttccgaccagtctcagattcttaaatcactgacctcccatttccagcttcgagattccttggagaccgactcttcgccagccccagagtcaaaataacgccagccccaaggagggcgggcccatttgggcccgccctccttattacacccatacctgcaaactgagaaaaagatttcctgtattcctccaatttgttcttatcttttttttatctgtgacgataaaactaatagattttccagtctttgtttcattcgttcccgttcagctatcttgaggaggccatctcatgttctctgaatattccatccaccgggtatctgttccaggggcaggccgttccccccaggccggtgcagcccacagcacctcccgcccccaagcagagcgccaggtctacgaccagttccagctcagtatacagccaagcggggaggaaacgcgcatgaaagagcttgtcgggcgtatttcacaggaaatccgaatccggcctacctgccgagaaattgagtccctgcaagcccaaatccgggaggggcgttaccagcccgacccccaggaaattgcagcccgcatgctgctccagaaggaggcggactgaggtggaatacagcgattacctggcgctgctttctgagttgtgtcagctctttgaccagatcagccatgtggagcagcaaaagattgacgcggtgcaggggcacgctctggacgagttgaacgaagccatgaagcgggagcaggccctcacgcttgccctgcggggctgcgagcagaaacgggagacccttttgaccggactcggcctgaccggcatttccctgcgtgacatgccctcccactgcccgccggaataccgggcggagaccagccgcatggtggagcaggtactgaagggctacgccgtcctccaggccgcacagggctccgcccgtactttgaccgagctggagctccgccgggtggatggagaattggcccggcggggggtggagccggatgcagaatctcactaccaggcatccccggcccggcccaccagtatgaaaacggacttcagagcataggaggtaacagcatgagcagtacattcggctctcttactacagtaaagctggggatctacgccgcccagaagggcttggacgtgaccggcaacaacatcaccaacatcaataccaacggctacacccgccagcgcctggaccaggtcagtctgatctccggcggttcagaccgctaccactcccagtacaacgtgcgggtggggcagggcgtactggtaaacggcgtctcccagctccgggacccgggactggacatctcctaccggaaatcccaggccgatgtgggctcggcggattcatggctcgccggcctgaagaagctggccggaatcctggacgaggtgggcaagggcgacggcgagcaggatgacggcctgatcctcaaccaactcaacgatctgcgcgacctgatcaacaaggccaacaccaacggcattgagggctatgactctctgatccgccagtccgccgacactctgtgcgacctgttcaacagcgccgccaaggctctggccgagctgaaaaccacctttgagggctacctcaagcaggatgtggatgagatcaacagcatcctctcccagattcaggagctgaacgtggccatccgcaattccgatatccgtggagacgagggcctggagctgcgggaccagcgcaacctgctgctggataccctgagtcagcacatgaaaattgacgtcacctattccatggaggatgtgggcggcggccttatggtggagaagctcacggtcaagctggccaccggaggcaaaaacacgctcattgacggcgaatttgcaaccaaggtttccaccggggacgaggcaaatggatatgaggtaaagctgggtgctcttcgtgatatggacaataagaagcagaatccccaggatatcgatcccgttacgctaagggataccgacctgtatggttccctccagtccctgcgggaaatgctgacagagaagggcgaatactccacccaagccgagatcaacaacgataaggacgccaccgttaagcggggtatcccctactaccagatggctctggacagcctggcaaatgagtttgccgagcagatgaacgcgctgaaccaggcccagggcgtcactggggccggggatctctttatgaaccgggataatccaggtgataagatcaccgccggtaacattgccatctcaaaggactgggcggagggcaaggtgcacatgctctcctccaccgaccccaacgccccctccgacgaccgctccaacctggccagattcctcgaggtattctccaaagagcaccggattgatccgagtgatattcgccagggtgccgtgggctcctccgtttccatgtcgttcgaggattggctgctccgcacccagtccaccctggcagaggatcagatgggtactactgccaagctgaacaactatctcaccgtaaataacaccgtctacaccgaccgggacagcgtatccggtgtggatctgaatgacgaggccacgaatctgatggtctatcagaaggcgtataccgccgcctgccggctgatgacagtattggaagaggctctggattccctgatcaacggcatggttgtctaaggtctggaacgggaacaataagaggtattgattatgattcgtattacaactaacagctccctgcggatgtaccgctccaatctcatgaagtccaccaactccctgaactccgccatgaccaagctgatgacccagcggcagttcagctcctatgcgtcgaatcccgccgcggccacccgggccttcaaaattcacagttccctcaacgccaccaatgcgcagtattccaacaacgacaccgtcctgcataagtacgagacggcgtggagcactctggcgagcgtgctggacggttatgacggtctggtacaggacaccggccgcgtccccgccctcagcggcctgaatgataccaacctcagcaccctgaatacccaggggcagatcatacgagagggcgccgaggccattattcaggccatgaacggcaaatacggcaataattttgtgttcgccggggcggactccctgaacgccccctttgctatcaacgataagggctttgtcacctaccgcggcgtcgagatcgacaatccggataccctggatgatatttacttggacgataagggacagccaattaaggacgcaaacggtaaggacatgaccaacaaagaagtcttggatatgtggaatgaggaacaccagtacgtggatatcggactgggctttaagctggacgggaacggcgaggtgatcccctccacagcctttgactccgccatctccggtatcggtatcatgggctacggcgtggacgcggacggcgatcccaagaaccttgcctctatcatgctccggctggccgatatttttgagggctatgaccatgagactcagacatggaatgttggaagccgctccgaagcggaggagttgctcaagaagctggatgcctcccgcgaagccatgggggagaagtggaccaccctggatactgaggccaatttcctggacaaaaacggaacccagttggaaaacacctacgatgccctcaatgtggagcgcagcaacctggaggacatcgacccggcggacgccattctggagcttgtatgggcccaaacctgttacaatgccgcccttcaagtgggcaccaatgtgattcctcagtccctgatggactatatgaagtgatttctatcctttgtacggaaaggagcacgtcccaatgcgtcccttgattgaaattcagactatcccaattgaaatccagatgaaaacgaccaatgcccatctggagtatgcccggggcaccgcccagatggaggtctcccgcgaccgacgcgggctccagatccgcagccagcccattcgggtcaacattgatacttttgaggcgcgcagttctatcgtccccaccaccgcccagagcatccagcagggggcagcccagggacagcgtgcggcatacgaggctaccgccgtcctggcgcaggagggccgcatgatgatggaggccaaaattgaccaggatgtgatcccccagttggcacagcaaaaaaccgtggaccagcccgctcagcttggcatccagtttctcccggaggtgggccccgatatctcctggaccggcggggaaatgagcatccgctatgagatggataagctcaacttcgactggcgcatgaaccagatgcagttcacctttgtccccggcgacattgagttcaaagtgacacagcagccggatgtggtcatcaaatacatcggcggcccgctctatgtccccccttccgccgaccccaactatgagccgctggatacaaaggcctgaacggaggcagccccttgaagtttgaaacgaaatactttggtaccgtggaggtccctccggacgaggtgatcacctttcccaacggcctgtttgggtttgaggaggagcgctcctttctgctgctccccttcgccggcagtgacgggaatatgctctgcttgcagagtgccgccaccccctccctggcctttatcgccatgaatcccttttctctgcatcccagctatcagccgctgctctcttctgaggaattgcgtgagatggaggtcaaggacagccatgccctgtgctattatgttctctgcgttgtccgggagcctgtgcaggagagcactctgaacttcaaatgccctgttgtagtcaatccggacagccgccgggccattcaggtcatcctggaatcggatgcctaccacatgcggcatcggctggcggagttccaggggggaaaggcgggcaccctatgctgattctaggccgaaaagcgggtgaatctttgacgattggcggggatatcagtatcacggttctctctgtggactccggtggaaatgtgagcctgggtattcaggcccccaaagagatgctgatcctccgcagcgagctgcagcaggccgtctcctccaaccaggaggccgcccagagcccctctactccacagctcctcgcgtctctggagtctgcgttccgcagggcggaggctgtaaccccgccgtcgggtccgcacagatgattttgaaggattggagacaggttgaatgaacatgatggatggaatcgctgccacagccagcagccttgcgtctgcacagctccagcagagctatacgcttgccgtttcaaaaaaggcaatggagtcccaggagctggcagtacaggagttgctgcaaatgctccccccctcctccagctctggctatcagtttgatgtctacgcctgagcaaaagcaggcatggatactctgcgcagagtatccatgcctgctttttactataaatgcctctgatccgcggtgctgcccagagccggtatgcacggccggaatgacccacatacgcgcaccgttttacgtgatattgttagcgtcaggcgaaattaaccactccgggtcaggagaaaatcgccaattttagtcaaacgaaaatcgccaatcaagtgtagccagcccccggacggcaaagtttatacggtcgtctgtgcttcagcctgggaggtggaggaggtgcgcagggaaaccgtctctagcttcctgccccggaagctctcccccttaatggtaaagaccacagcatcgtcaaagatgcggtccagcgcacacaggagagcatcgttctcggagaagttctccttccactgggcggggtcccggttgctggtaaagaccatgttggagtagccgtccttctggtagcggcggtccaccatgtcaaagaacagccgggtgttctccttgtcaaactcgcagtgccccacctcgtcaataatcaggcaggccgggcggacaaggtaggccagaaggctgctctctcggcccgttctccgggcggaggtcatgcggtcccgcagttccgtcatcttaatgaagcaggtcctaaacccgtgctcacagcaagcacgcccaaaagcctgagctaagtgggtcttgcccgtaccgggtcggccaataaaggcaaggtttttgcgggcataaagtgcggatagcgtgggaaggctgcgcagccgctccacattcttgccagtgatgcggctgaaatcaaagttgtcaaaagtcttgggcaccttcatggggaggcggctggtgcggagcatgaagttcactgtggagatctcctgcttcgtcagcagacagtcaaagaccttggaaacagcgaggacttccgcatcggacatgtcgttctgctccaccactgccgcaagctcctcaacggtgaggccgtacttggtcagtacccgtgtagcatggaccaccgcttcaaacagagaattagtcatcctcgtcatcctccttggtgaagttaaacttctcaaaggagaggtctgcgggcggctgtgggagctgcctaatcaccgttttcaccggcatggaggggaactcctccggctgttccgggaaagcaaattggttggggcagaagctgtcgtagtggctccaggttacttcatgcgtggtaagcagatgggccatgtctgcggagtagatatacaggcaggagccgcttcgcatcacgcgggcggtcttgcccccgtagctgtaagggacgccaaagcgccgcccctcgtagttcacaaacccgtcaaaggaaatccgccgctcagggcaaaggtagaacagcagctccgggcggtcatccagcttcgcaacaacggtggcacaccgtttccggtggatgtcctgcgggatgcccagcccccggtggtagcaggtgttctgctcgtcgcaccagtccagggcagacaggttcaggtcagtcacattccagaaggtccttccggccaggaagttgtccttcacgaaacggaccagacgctccactttgcccttcgtaaaggggtgcctgggcttgcagagtttggtctggaaacccacagtccgcatgaactgctcgtagtcgctctgccagatgggttggccgtcctcgccccgccggatcaccacgctcttcatgttgtccgtgaggacatactgagggacccccatgtactggaaggcgtgaatcatgccaatgaacaggttttcctgcttggcgttggggaagaactccacataccgctcaccacaatggtggcagaccatggcgaagcaggcggcggagtattcttctcccaggtgggactgaaccttggtaaagccccagtccatctggaacgcctcgccgggggctgtagtgtatctccgcccccggtttccctgcggagcaaccgcataacggacaggagggatgagatgctggtgggacaggatgtagttcttaatcgtggtctggcttccggcatacccgtttacacggagcctgctcaggcacacggcagagtttgtcactccggctttcagcaggccgtccaggatgcccgtatagccgctcaggagggtcgtgcttgccttcttgcccttggatgcgtgctcggtactctcgaagtcatgctccttcatcctgcggagcctggcacgagaaatcccggtgcggcgctccagctctgcgaggttgattctctccagggagaactcgtctccctgctccgccatcatctgctcaatgacctcggccaccgctggaagcatggcgggaaagttaggttttttcatctggtctcctttcaccgagggctggctatgccctcagtgtaaaggacttattcaatttgtaaatggcgtttttcgtttgaccagaattggcctttttcgcctgacccggaatggcgattatcgcctgacgctaacaatatggttccgtgttcttcggttaattccgttcgtataatgaaatccacgttaaaaagctatttttactcggattttatctttgcaacaaatccaatcctgatactacccagggcccaaacatggaagcaatgacaacctcgtcagggaccgccgcagtctgacaaaaaaccgggttatgtgtcaaacataacccggttttctgtcttttcggggccaattgatccattacactgatacgatatctgcaagtttggtcaggaactcttcccgatggaacggcttgtagaggaaaccctttgcacccagagcattggactgtgcaaccatttcatcgtaggccaatgaggatacaaacaggattttagcggccggccatttttccaataacctgcgagcagtctccaacccatccatccccggcataacgatgtccattgtgacgacatccggctgaatatcagggtaggtcttgagcgcctcctccccgcttctgcaaaattgagcaatttcccacccactgttttccagcatcttactcatactggcatacaccacacgggagtcatctacaatcatcagcttcttactcatagttctttctcctctccttcgtgtttggcactgattgcagtcataggcagaggtgcgtatccgagctccagccaaccatacggacagcagaattgggtacatgtttggaagggaacagcctctgaacgaaccttatgtccaaaaatagggcaacaaaattttgcggtcacccctgttacgcgaaagatttcagccacaatatggccgcagagcacattgaagtattccactgcataatcagcaacatcctccagagtaggcgactcttccatcatattttttgccaagttgaaaaaaaagaggtaattgctagtcaatgtaatccgggagtggtaaccgccgtacaatgtagtctgaacttgacagcctcccgtttccgcaggaaagttctcatccaggactggccgcagttccaactgtccgacatgtcgggtcacctcgcatgcaacccgctccatgatgcgggaaagctcagaagcaagcgggactctctccgccatattgtatattcacctcccttttgcttggaaaacaactaccgcagtcactgataatataaaatcagcgcagttgaattcctttttttgagagatgcacattgcattgtgtttccaggttggaaacggtaatggtatctgagccaatgctgattttcgccttcggataaaccacttggcagcatagccgacactggcttaggtcaaatcgttcctcacgcagcagcttaagccgcctgcgcatagcgtccaatttcaggccggttgtggcgtaacgcagtctgaaattagaaatctttgcgctgatttcttttgagggctcctgctgctccagatattccaaacttcgctctaattccttgtgttccttcttcatctgttccaaggatcgctccaaatccgttgcttctataagcgcaaaagagcgctgtccaagtgcaatctcagtcaatacccccgagcgagccccaatcacatttacgtcaactcggtcaaccgctgttagcaggcccccaataacggtaccgcgcccacttacaatgcggatagcaccatcgctgtaaagctgtgcatttatggcacaatccgccaagattgcagtacctgcatatacgacgcagttttccagataagctgctcttacagttcgaccgcttttaatcattgcggagttatcgcctagtacccccttggtaatgattatatcaccgccagcctccacaatggccccctcgacagctccgtcaactgttacggttccggtggtatggacggaaaaaccagcgcaaatatctccacgaatgataatatctccaacgaaatccaaatttcccgtgctgtaatccacatttttctccaccactagggtaggacgaatgcgaaagacaccctgttcaaaaatgagatttccgctggtcagcgctaccagatgctgcccatcctcactgacgcccgtgttttgcccttgtggaacatgcggcgtctgcccagcacggctttggatgacatttcccgcgatatccactccgcttgttccgggagaaggaggaatgatgtcacagatcacatcgccttcatggataatgtttgtataactgctggaacgatagtccaccagtccctgcgctccctcttgaggcgcagtctgcggcggctcccgaggtactagttccacaatccgcccgtcatctccggggatgggagcaagtccataggcgactacactcaactgaaagtactccggactatccgcaagctgctgcagccgctcgtgatctatcccgaataagacgcctgcttcgcaaacagaatgctcaaggcgatccaaggaggctggtttgccgccgccggtcggcggaaagagaaacagccatgccaccattttgttttctgatagaaacacacatggcagagcatccatcgtggtctgggcatccgctccgcgctcccaaaaacgctgctttgccaagttcatcaatttcagcttaatctgggtaagcgccgttttgctttcctcatcgttcagaagctgcctgccgttccggccatcctccagcggcaggttcagaacatagtcaaatgcattcactccaacttgaatgtcgttccactcactccacagcgcatagagcaaactgttggtcggtgtatttacactgtgacccgcctttttctggggagcagctggggcttgctccgtggagggggcagacaggtgctccgtgggcaacactgcttcctgtaacacatcctgcgcatcctgcgcctgctcccctccgccgccatacagccgcataaccagccggtgcaggaagctgcctccatcgccgtgaccgttcccctcgacgggcaccctctggcagtccatatctttcaacatctttcaactcctttccgtaaaattgtatatccttatagaatttatcggctctacacctagaatgttaatactttccttaacacatcttataagaaatattcagcccctatctgatgccaggccgggctgggccgcgccgtggcgcggtgcatccatcacagccttacaggcgtaaataacctgtgtagtcacatcgccgtcatagcgcgcctgatataggctaagcatcggtttttatgttcggcgggcagaaccacatatttggccggcagccgggtgagggccagcgccttcacatccgccacacagcggggacaggggcacaggccaaacattttgacatagcgctccgccttctcctccaccagtccgagcataacattcacccactccgccccgtccggaagtccctgttccaccggcttctgttcctgcatgggactggccatgggaggcattggggcggaggggggcaggggctctgccgggtcatcgggccgctccggttcctccggcggctctgcggcgggctgggccgcatgttcctcccccgcttcttccgcccgttccaatgccctctcctgggcctgctcttcctccagctccttttccagcgcgctccgaatggtttccgataatgcctcgctattggtgcgggccacctccacaatcggcggcaggatgggacgctcccggggcggcgggggaggcgtgggcccggcctgcggctcctccgtccgctctgtccccgccgccgggcgctgctccggcgcctccggcgcctctccccccgacagcaggttgagcacatgggcggtcttgctgctccggctcccctttttcccggccattaccgcacctccccatctgtccggcgtccgccgtgcggtataaagccgcccgcgatctcctcgcacagcgcctcaaagtccagagacggcttggagcgcggcgcatagtccagaacactgaccccgtgggcaggggactccgccacagaaacgctgccgcggattttgctctggaatactctggtatccagttgtgcggcaatctgctccgccatttccagcacctcccggttcagagtgagccgggcgctgaacttgttcagcaggatacccaatacccgcagccgggaattgtaataactgcggacgctctcgatcgtctccttgatctgggaaacccctagcaggctcaggatctccggcgacatggggataatcaagctgtccgtagctacatatgcatttaccgtcagcagactgagggccggcggtgtatcaatgatgatatagtcatactgatcttctaccttggacagggcggttttgagcaggaattcccgtcccggccggttaaactccagctccgcgccggacagcagaatgttggacggaaggatgtcgcaggtatctgtccgtacaatggcctgctccggctccgcctgcccccggaatacgtcataaatggtggtgcaatgctcaatatccagccccagactgaaccccagactcccctgcgggtccatatccacacctaatacggcggcgccgcggcggtgcaggccggtcaacagcgcggcagcggtcgtcgtctttccgacgccgcccttctggttcgtaatcgcaatcacggtggtcgccatgtcccctgtacccctttcacccatctccggccggagcagagcaggttttcgcaccttttcgtcagaaaaatcgaaatcctctcttaattttccctttggccggacgataacataatacagagtattggggcctatcaacacacccattttactcagaaagccaatggttgtcaatcaagccatattttcatgttgcacgttgaaaggagtgggcagcatggcatctatctccagccttatgagcagtggttcctcttccagcatctatgggagccgaaacagcaacatcatttccggcctggccagcggaatggacaccgaggccatgatcgagggcatggtacaggggtaccagcagaaaattacacagttggggcaggaccgtaccatgctccagtggcagcagtccgcctatcagagcatctccgacaagctggtggagttttcccgcaagtatatgtcctacaactcccccgccaccaacctgttcagcgccagcttcttcaacaacgcgatcctcacctccgccaacgggacctatgccgatctggtgagcgccaccggcaagagcagcagcaccattgtgctcaacgccgtggcacaactggccgaggccgcccggtatacccatgacgcctccgggctggacacgtcccttggaaagggcgagccggtcaagctgggcgaaaaacagccgctgagcaccatgagcggctcccttactttggagtatggcaacaagaaggtcacgctggacttcggagagttggagttgttcaacaaggccgacggcactctggacactgccaaattccaaacggccctccaggacaagctgaaggagcagaagattaccaccagcagcggcgaccaggtgagcgccgataccctcattgatgtcaaggtggacagcaacggcaccgttaccctcagcgacaagaaaggtgctggcaacaacgtccacttcagcggtgccaccggagatcttaaaaatctggtcacttctgccgatgccgagggcacctccagctttactctgagcactaccgagaaggtggtgaaggaagacgccaccaaagcggaatacctctctggtaagagctttaccgtcaccctcaacggccagaccaagacctttactttgggcgagattgatccctcaaagggcaatctccatgagcaggtcaaacagaacctccaggaaggtctggacaaggccttcggtaagggcaagataacggtcgatatggatactactggccccggagagcgctccttctccttcagcgtcagcaatggagacactttccgcatcacctcccctgtcggcgaggtgctcggcctgggtgagaatggtgtgacctcctatgtggacactggcaaaaccttgggcgatctgctggggcggacgagcgacggtgcgggcttgaatggcctgaccggcggcgagttggccagagccattggtgatgtgactgagataaaggacaaggacggcaaggtgacctcccgtgtggattccgaaggcaataccgtagacgagcagggtttccgtctggacaaggacggcaagcgctttcaggagtacgagctcaccgttaacggcgtttccattggcaaatacaacaaggacaccgccctggagactgtgctcaatgatatcaacagcaacaccgaggccggagtcagcgtcagcttttccaagaccaccaaccagtttgtctttaccgccaaggaaaccggcgcaggcggacgggttgagattggcggggagttgggtgaacggctgttcggtaaagtcaatgtaactgataaggatcactacactgctgggcaggacgcaaaattcaccgccaccatcaacggccagaagatggagttctcccgtagctccaacacctttgatttggatggcatgtccatcaccttaaacggcacatttgaggtgaaagatggagaaaccccggtcaccttctccagtaagaccgacacggacaagatcattgacgtggtcaagactatggtggaggactacaacgccattgtgtccgaggtcaaaaaggcctactccgacatgcctctggagaagtcagacggctcccggtacaagcccctgactgacgaggataaggcggacatgaccgagagcgagatcaaggcctacgaggagaaagcaaaaaccggcatcctgtttatggaccgggacctctcctccctgtacagcgccctgcgctccgcagtggcccccggcggctccgacggctccttcctccgctccatcggcatcaaaaccagctatgaggacggcctgaccaccctttcgctggatgaaaacgcgctccgcgaggcactggaacaaaacccggaccaggtcaaggatgcgtttaccaagagcaaggaaaacggcgccgccagcgacggcctgatggcctccatccagaaggtgacggaccgctatgcggccactaccggcgcaacaaagggcattctcattgaaaaggccggctccaaatactccccctctgccgctctgaataacactcttttggagcagatgaaggacatcgacaagcaggtggataagtggcaggccaaaatgtcggacaaggtggactattacaccaacaaattcacccagctggaaatgctgattgcgcagatgaactcccagagttccagtctcgcgggaatgatgggcggctattaacgccgccgccgttccggaaaggaacatgatacatatggatatgcggggttaccagcgttaccgtgaggactccttaaataccatgacccagggtgagctgcttttgctgctctacgacgaactgatcaagcggctgacccaggcggaattgagcctgggtcaggagaattacgaggtattcgagggagcggtcggccgcagtgtcgatatcatccattatctggacgacacccttgaccgccagttccccatcagcgccaatttgagccggctgtacgagtacttttgctatgagctcagccgggtcgtctcggggcgcaacgccaaggagctggcccgtgtgaaggaaatggcctcagagctgcgggacagcttccggcaggcggaaaaaagcgccgccacttctccgcaggagggcgtataaatgctgacggaacaacagctcacttcggtgttggccacggagcgccgcatctatgcggcgctctccgaggtgcttgagctgacgggagagctctccgcctccatacagcggggggattctgtctccgttcagctctttctccagctccggcaggagccgatcaaccaattgcgggaataccagaccaacctggcgcagcagtgccgcatccttccggcggaagaccagaaggagctggaggggcttttgtccgggcaggccccggcggccagtcccgctgcccagcccctccaggagcagcttcagcgcaaccgcgccctctggaccagggttgtccaggccgaccgggccgccagcggccgcctgtgcggaaaggattccttttacgattcctagccccgaccgttttttactggtgcatggagatccgccacagcggcgcgcccgagctgcggctggatgagagctcatccaaaatgagctgcggctcccaggcggccagactccgctctctgctgttcgggtctgccaccagtacacggccttccagggtcacgccccgcaggataataaagtggccccgctcggtgaaatggccacgggtcatcagcgcaacaaaaaggtgtccggatgccagttgctgcaccagagcatcggcggaggccgcctcataggcctctgcttccagtccgatggcggacgcagttccctccacaatggacagataggaaccgctgccaggggcgcagtacccctgctgataggcccagtcggccatggccccggggtcggtttcttccccagtcaggctggaggccagcatggccatcgccgtgggcccgcagccgtagccgcggatcggatcattaccgaaggtctggctggcccagggttcctctccctggttgtagtaaaccagatccacgactccgccggtcagatactcccgcccgtcccgggtgacaaactccgtgaccttgctctcctccgccggagggacctcttcaatggcgggcgggccggccagttgattcaccatttcatcttcccccggtcgggaaagcagctcctgcaaattgctgtgtagtgcctccccgaagtccgagacacgctgcatcaatcctgccacgggggccgtgagccgctggaacagctccggcgcagcaaagcggcaaaccagcagctccaccccaccaatacagaggagggccaacaaaacaagaagtattatatttcgccttttatgcggtctgtttttcgtaccggacataagagtacctcaaaatttttattatataatattttctttattatagcaattttttcttttattgtatacaggcaaaaggagtccacatgccgcaaattcggttagagcgggtcagcaagtattacccgcaggataaaaagcaaatggccgctgtgcaggaaatcaatctgacggtcgagcagggtgaattcctctttctcacaggcagcagcggcgcgggaaaaagtacgctgctccagctcatatccggggatcttcgccctacctccggggccgtctttctggatgatatcaacctgacgcggctttccaggcttcgccgcgaccgcctgcgcctggttttcggccgcgtacctcagctctcacagctcatgcggaaacggaccatctccgaaaatttatccgcagtcgccatgctgacgcagagccggaagctcccgcctatacaaacccggattcagaagactttggctatggtcggcctgcctgatgtgggagcgcgttacccagtggagctatcctatggggagtgccgccgggtggaactggcccgcgcgattatcaacagcccgtccattttggttctggatgagctgaccgcgaacctggacgaggacacgatttgggatattctgcatttgctctgtgagataaaccgccatggtactaccattatcatggcaacccatgcaaaggagtttgtgaatctgcttcggaaacgggtcattacactggtggatggccagatctggggcgatgtgcaaaaagggcggtatggagatattgtatagcctgccgccgactatgttaggagaggtgtattgcaaatatgtgcaacatggaaaaaaatcttaaaattagaatgcggcttttaattgtattcttaattaccatcctgatcgcgttggccttgacattcctttcaatcagacagaccatcaaaatccagagggactatacatccatcctctcaggtcccattgccattaccaatgccgtccagagcagtgaaacggagatcaattcgattgcccgtcagcttagggacatggcgctgtccgggtatgatacctcaatcatggatgagattcaggcctccgtggattcgatcgagaagtcgatctccacgattcagaccctctatacggattccgacggcgtcgcccagacttatattcagtctgtacatgaatgggaaaatgcctttgaggatatccataccgccctccaagcggataatcttgaggaggcacgtcggctaatcgaaacacaatgcactccgaagctgaatcaggccgtaagtgacgggaatacgctcattcgtgaagtccagaacgacctcgatgctcagatcgactctacacaggcaagtgtgagccgcaaccagattgttctctttattatggccatcctggttgttgccattggtatactcttgaacctgcgcgccattcggaatattacccgtcccctccaggaggcgcagcaggctgttgtcgctttcagccagggcgatctctcggtggagctgacctatgaggcatctaatgagatcggaaccatctgtgatgcggtccgcacctcccaggatattcttggcagagtcattgaagatattgttcagatcaccaaaggacttgccgacggcgatctgacggtggaaagccatgaggaataccccggccagctcatgcccatcaagacaaatattgagtatctcctccagaacctgaacgccaccatggcggagattctcaacgcctccgatcaggtatccgccggggcggagcaggtgtccgtcggttcccagtccctggcccagggcgctacggagcaggccagcgccgtccaggagctctccgccaccatcaatgagattgatacctccgctcagaacagcgctgagacggccaaaaccgcgaaggaaaaatctgacttggctgccggccaagttcaggtctgtaacgaccgcatgcaggagctcagccaggcaatggacgacatctattccggccagaaggatattgggcagatcatcgacaccatcgaaaacattgccttccagaccaatatcctggcgctgaacgcggcggtagaggccgcacgcgcgggcagtgcaggcaagggcttcgcggtggttgccgacgaggtgcgcagtcttgcctccaaatcggaccaggcagccaagcagtccaaggccattatcgaaacctccctgtcccatgtggagcgcggcaagtccctggcggaggaggtaagctccagcatgcagcaaaccgttgcctccgcctccgaggcgatttcctacatggaaaaggttgccgacaacgcaatttcggagtctcagtccattgagcagctgaccaccggtgtggatcagatctccgccgtggttcagaccaactcggcgaccagcgaggagtccgccgccgccagcgaggagctgtcctcccaggcagtcatgatgaagcagctcattcaaaaattcaagctgaagtcagaggctgactccgcctctgcccccctttctcccgccgcggacagccaggcctccctctcagccgcaggcaccgccgccaacccgttcagcaaatactgattgatcagaagtgcaggaggccacctcagcccatactgaggcggcttcccgcctttttccccaaacatatagcttgcgaagggagatgccgtccagaatgccgattcactccgatccgactaaaatggaagaaggagagctcatctatgcgcttgatataggtacacgcagcgtcatcgggatgctgggagccctggagcagggacggatacgcatactagccctggaaaagcagccgcacgccagacgtgccatgctggacggtcagatcgaggatattgaccaggttgccggcgctgtctcccttgtgacacaccgcctggaagaagcctccggccgaaggcttacctgcgcctgcgtggcagccgcgggccgggctctgcgtaccgagttgggccgcagcaccttggagctttcggcccctgaggccttgggtcatgagcgtatccaccagctcgaagccaccgccgtggcaaatgcggaacaagcgctgtccaccgacggcccggaggaacagcggttcttcctggtgggctacactcccacgcagttctggctggaccactatccgctgaccacccttctggggcataccggccagcatctggaggccgccgtggtcgctacctttctccccagcgaggtggtggactccctctacgcggtcatgcagaaggccggcctggaggtggccagcatgaccctggagcccatcgcggctctaaatgccgcgattccggcggatctccgtcttctcaacctggccctggtggacatcggggctggtacgtcggacatcgccgtatgcagggacggcagcgtggtggggtatactatggctaccgtagcaggcgacgaaatcacggaagccctgatgcgggcatgcctggtggacttccccacggccgaggccatgaagctggagctgggccgcagtaaaagtgtgagctttaccgatattctggggttggagcagaccttgccggcggaggagctcttttctctcctggacggccccatccaggctctggccgatgagatcgcacagcgcatctgccaggtcaatggaggtcctccctccgccgtctttttggccggcggggggagcaagctccccaccctctgcgcccgggtggccgcggccctcggcatagattccaaacgcgcagcgctggcaggaggttattttcagtccagcgcctactccgataccttcgcgctgtctgatccggaatataccacccctctcggtatcgctgtctctgccggcctcggccttatcagcgacagttatcaggtgctgctcaacgggagccccgccaagctcttccgcagcgggagccttacggtgctggagctgctgatgatgaatgggtaccgctattccgatctcatcggccgcagcggcaaaaacctgctgcttcggatagacgggaggcgcaatgtgttctatggctcccccgccatccccgcccaactcgccatcaacggtgcggaagccgccccttctgcactgattcatgccggcgaccgtattcactttacccctgcccagcccggcaaagactgtgtcatgaccgccgcagagctctgtaccaagctgcggtgcaaggccgttcagcgtgaagggcgcctcttggaggggcatacggtgctgcagtcgggggattgtctggagcgcatggatgcaccgccggcgccttctcctctcccggcccgggaggcgccggcccaggcttccgtcccgccccaacggcatgtctttctcaacggccagccccttacgctctccccgaagccgaacggaagcccctaccggctcctggatctgctggagcggtccgggctggacttccaacatctggaccgccctgtgctcacgcagatcaacggcgtggacagtccgtttcagcaactactcgcggaaggtgacaagattgaaattcgataccagccctgagcgttccagaggccggcggcttttgccgcttctcctgccgccgcttctgctctctgcctgcggcggcaaggatgtcccgccggagcagtactccagtaatgatactgcactccccgccctgacctccaccctctcttccgaaaacattcaattttcccacaaggagggcagtgaggatcagcctgactcctacgtctactccggtctgtcctccatgaccgataccctggccagttatgtccaagccttggaggaggacggctgctctccgattgacaccaacggcgttgtaaaggagctccccgatttctctgtctccagcggctcggtatccatgggcaaggataccggcgatggcggtgtatttcagctccaaattgcctgggagggggacacctgtaccatcacccccgtctatgcggccgagttgcgcattacccagcccagtgtgcaggctctcaccgtctccgaggctatccagcgtttaaaaagctgtactcccgcccttctcgggctctcgggtgcctccatggaggaatacgaggtctatgcggaggaaggacttgtcttggtcgattcctccccctgtctccagcttaacgtgtattccagtaccccccgtcagtatcggggctgctatctgatgaccgttgatggcgctcacctttatcagcttgaccgtgacgcgtctcaggttacggaactgacgccttattcaaatacggccgtgaaatgacgcttggaaaacagttgccggcccattaagccggccaaacgagagcgccgcctattcttataataggcggcgcttttccatgttcacagttcacacagtctgccccagcgctttctgccgtttgcccctggctctttcccctctacatattagtccatcaccattcatagctttttatggaggtgattttgtgaaagctaccaatttcattgtgacggagcggcggctctcctcggaacaatttcctgatctttctctcatccggcgggctgtgaccttatggcttagaaatgcactatacagacggctttaagcccatatttcagaatcataatacgattacccgaaataccttttataggaagagcgtctcaagggtattctgccgttgagtacggatgccttccggggaggtgtaagctatcctttgtgcgatttatacccggctgagcaaagaagacgaggacaaatacaaaacggaatccgagagcatccagaatcagaaatccctgcttgttgcgtacgcagtggagcgggggtgggacatctaccacatctactgtgacgaggactactccggcgccgaccgcctgcggcctgacttcaaccggatgattcaagcggccaaggagaaacagtttcagattatcctctgcaaaagccaatcccgctttacccgggatatggagttggtggagaaatacatccacggcctgtttcccatctggggcatccggttcatcgccatagccgacaatgccgacacggaggtaaagggcaacaaaaaggccaggcagatcaacggcctggtcaacgagtggtatttggaggacctgtccgaaaatatccgcatggtttttgacatgaagcggcggcaggggcggtacatcggcggatttcccatctacggctatcaaaaagacccgaaggatcacaaccatctcattattgagccggaggctgcccaggtggttcggcaaatcttccgatggtccctggagggccacggcaagcaggagatcgccaaactgctcaatgaccagggcatcccaaatcccacccgctacaaggcggaacacggctgggccagcggtcacccggtgtccaacagccacggtctgtggaacaagaccaccatctggcgcatcctccgcaacgagatgtataccggggttatgctccaaggacggcggaaaaaggtgagctacaagtccaaggctctgattgacatgcccaaagaacagtggattcgggtggagggcacccatgaggctatcattgaccgggagctgtttcagactgtccagcggggactggacctgcgctccaaaacggacggcaccggggaggtccacctgctgtccggtctggtcaagtgcatggactgcggcagcaccatgagcaagaccaccaactgtcagcgcggccggcccagggtgtcctatctccgctgcaagctgtacgccgacagcggaagagaaaagctctgcacccgccattccattcgactggaccaactgattgagctggtatctgagcgaatccgccactatgtccaaagctgctataaactgaaagaactggagcttccaccaccgccggacacccgcagagatgcattggaacaggaacagaagtccctgaccacacagttggaaaggcggagtcaggcgctgaaaaatttatatctggatcgagtatccggcattctcagtgagggacaattcgtggagctgaaccaggacttcctggccgaaaaaagccgcctggagcggcggctggcacagattgacatagaactgggggagcgggcagagccgctggaacaggccgctttgatggagagggcccgggaattgctgaagctggagaccattccgcgggagttggtagtcgccctcattgagaaaatcgagattggggagaaagaccgggaaaccggaaagcaggagatccgaattacctggaagttttgaatttgcaggcgcatcccccagggcgtgacgccctgtaaaactgtcctagtgctgctctctcccacgtcgtggagccaaaatatccggggttggtggagcgttacgtcaatctgggcgactgctacgaccgggcggggctccagcccctgcgccaggagctgatgggctgtatgaagggctacaaggcctgctatcagcgggcctaccgctgtctgacggcggcggcccagatcggggaggatctccgctccctgctgctcaccccggcgctggaggccaaaatggccaaacgggcccggggcattctctcccgggaggtcaagaagggggacggcgaggccggccgggcggtgcagcgcttcctgggcggcgtcacgtggaagggggtattgtgccagtttgagacggtagacgccctgtgtaagcgggtctatgagctggctgacacctatgggctggcccactccatgctcacccacctggccgccggggcgctggcgtcgggccacgatgtcatcgtctgtccctcccccctgttccccgaccggatggagcacctgctcatccccagcctgtccctggcctttgtcagcgcctccccctccctcccctatcccaaacgcccctaccgccgcatccggctggacgccatggcggacgcggagctgctgcgccgcaacaaggcccggctcaagttctcccgcaaggtctccgccgccctggtggaggaggccgtggactccctggcccaggccaaagccatgcacgacgagctggagggcctctacaacccccacgtggacttcgaccgggtctaccagacggcccaggccatcaccgacgagctcaccgcccgcctgtaaccaaaaggagaggctgccgcatccgcggcagcctctcctgctgtttgggataggaatgggaggggggattaagcctgagggccggccttgtggtgcatggccacgggcttgacgttgaagttggagcggtactcggtctcgtgccagaagatatcctcggccaccaggcactcggggttgagctccaccccgtccaggatgatctccttgaacttcttgtacccggcgcggtcgatgaggtggccgccgtggaggtactcgggcttgtagtccatgacccaggcggagaacttctgccagttcttgagcacgccaagcaccacgtcctcggtggcccagttgaggaacatcttgccggtgcggggagtctggcggccggtgcggccgcccaggatcacccggtagaacttggtctcctggcgggtccaggcggaggtgggacaggccttgacgcactcgccgcagcccacgcagcagcaggggtccttctcgatcttgccggtgccctcgttgagggagagcacccgggtggcgccgtgctcacaggcgcggacacaggcgccgcagccgatgcaccgctcggggtgataggtcatgcgggccacgccgatgatgccgaagtcgcacaggtgggccttgttgcagtcgttggggcagccggcgatgttgattttgatatggtaatggctggggaagatgatgggctcgatcttccgggccagctcgaaggtgttgcagttgccgcagatgcagtggtagttgcccacgcaggcggtgatgttgcgggcgccgatggtggggtagccggccttggggtcccagggctggggctcgtgggccacggtgtccatgttgacgccgcacagctcggcgtccacctctttgatgtactgctccagatactcgttcaccgcggggatgttctcatacttgatgccggtgatgtcgaaggtctggcgggtgccgaagtggaagttgccgtcgccccaggtgttggcgatgtgctccacatagctgaggtacttggcgtccaccataccgccgggcacgcgcatctggagcatgaactcgccgggcaccttggactgccggaagcagttcaggcgcatcttcttgacattgatatcatgattcatccttcacacgctccttcctcagtccaccagatcccgggccaccgtgtaggggaacacggggccgtccaggcacacgtatacctcgtcgatgcggcagtggccgcacttgcccacggcgcaggacatcttgcgctcgaagctcatccacaccttttcggcgtccacgccgttgttcatcagctccaggccggtgaacttcatcatgggagggggacccaccaccacaacggcgtagtcgccgtcgaaggagtcgaaggggatctccttgacaaaggtggtgaccaggccggtgcgccagccctccttggcgtcgttgtccagggcatagatggtggagaatttctccttccaggcctccagctcgctgtggaacacgatgccgtcctcattcttgaagccggagatgaggtgcacggacttggcaaagccggggtccgccgccagcatgttgagcatggagcggacgggggccaggccggtgccgccggtgatgaccaccaggtgcttgccccggaactgctccacgggccagcccttgccgtaggggccgcggaggaagagggtatcccccgcctccttctcaaagatcacgttggtgaccttacccacggagcggatggtgaactccagccacccgtcgccctgggcggacacggagatgggggcctcgccgatcatggggatggagagctgcatgaactggccgtgggcgggcttcgcgtcggtggccacgcggaaggtccactcatggcggctctctttcttcacgctcaggatttcacaggcctgaggctgaaccggattcgtcatttcgttcccctccttcttactgctgggccaggccggccttgatctcgttcacggcggcgttgaccttgttaacggtggcggaaatggagatgagctccgggcagcggtgggtgcaccggccgcagcccacgcacatgtggccctcgccgaagcgggccttgtagtcgtggaacttgtggagcaccttgtagcgcatccgctcgccggcagtggagcggaactcccgctggccggccatctggtcgaagccggcgatctggcaggaggcggtgacgcggcggcgctcgcccacctcggggttgtcgccgtagatgacgtcgcgggtggtgaagcaggtgcaggtggagcaggccacggtacaggcgccgcaggagatgcagcggccgtcaaactccttccacatgggatggctcttgagggccaggcgcaccgccttgtcgtccagatcggggacggtgaccttcagctcgttctcctccacaaaggcgggggtgtagccggcctggggcatcccctcgaagtagggggcgaacgtctcgtcggtcacctgaacctgcacgccctcgtcggagaacttcagggccagggagtagtcgtcggtcttgttggtgcccatggacacgcagaagcaggtgtcgtcgccgccgttgcactccatcagagcgaatttgaccttctcccgcatccgctcataatagagatccgtatagccgccgttgcccgcgtagatcttcgcctgcacatgctgggcgttgatgtcgcaggggcgggccagaatcaggatgggcttcttggggcccttgctggcgcggtactcatcctctgtgaagtagaagatggcctgctggataggggtaagaacctccttggccgggtaatcggacttgacctgccacacgatgtcctcatagtgctctacttccgcgtacttgatgacatccgtatccgagtagcggccctgcttggggaagcgcttcggggcatagacgctgtagttctgtttgagcgcctgcaaaacggcctctgcctgtacggcgttcagcgagtaacccatgctgaatccctcctaattgagttaagttctccttaaacataccacccgggccgcggcggtgaaaacttttaaattgttatgctgctataattattttttatttctccggcaaaagggctcgaaattgccaaacttttaacgaatttccccgttctgttggataagacgtgcccaaaatttttgcaggcgacatggcgtgaccgtaaaaagcgcagccgcaaagcggctgcgctttttatagtgtccacagggcccgggaggtctcccgcagctccgcctcaaaggcgctgttcttccgccagaggaaggtgaactcatgggagatctggaagtccgtgagggctacctggcagagcgagccctcggccagctccttctccaccgccttgcggtagaggaaggtgatgccgcagtcggccttgaccagctccttgatgacgaacaggtcgctgatttccacaatgtggcggaaatcgcccacgtggtggttgcgctcctccagcacccgctccaatacatcccgggagccggagccctggttgcgcaggatgaggttctccccgaacagggcgctgaggggccggggggccgcctgggccagggggtgagccgccgcgcacacgcagacatagggctcctgggaccagatgatgtagtcgtactcgctcttgcggaagtagccctccaccacggcgaagtccagctcgccgtcattgatcatccgcagcagaatctgggtgttttccaccagcatgtggacatccacgcggggattgcgcttcatataggcggccagccgctccggcagcaggtattccccgatggtcagggtggccccgaagcggatggagcgccgccccaggcgcagatccttcacatcccgtttcagcttctcctcgtcgtggagcatgcacagcgcggcattgcgcagcagctccccctcctcggtcagcgcgaggcgcttgttttgataggagaacagcttgacgccgtagtagctctggagatactggatatgctgggtcaccgcaggctgggtgatgttcagctcctccgccgcccgcgtgtagttccggtggcggcacaccgccaggaaggtatccatccgaaaatcaagcatcgcagttttccccctttctcccagtatactccaagaaaggccgggggaaaaggggctattttgcgcacagcccctccggcccccgcagacgccagcccatgccgcccatgaccccctccggcagctctgcctcgtagcggttcagccaccgggagagaacgcacagcagcgcccacaccccggcctggacggattctgcctcctccaggtagttccgcagggtgtccacccggcgctgcgcgcggtacatatccctcgccatctgaaggcgggggaccttgcaccggcggaccagccgggtataaaaccgcgcttcgtccatctcctcctgccgcccccactccaaaatccaccggatataccaatagcccttccgggtccggctgatgcccagatagtgcagcagcgccgccgcctgattttcctctggaattttagcacaatacgacatgatttccctcctataaacctttaaatgatttgtttctcttattttgagctttataattatttgttcttttaaaaatatataatataaaggctcaattcatcaagattaagcagtaaaataatttaataagaggaggtgatcacatggaaacaattgaggagtttgaaacgttcgtgcgtgaccgtgtggtcgcccttcatatgggtctgccccaaaagatttctgctcgtaaattaagctatgccatcgggcagagcgccggctatatcaataaaattgaaaccgggcagtctctgccctccctcagcgggctttattatatctgcaaatacttcggcattacacccaaagagtttttcgacgatggacagcgggcccctgaaaaactccggcatctcatggatgaattggtacagttgagcgatgcgcagttagaggcggtaacggccgtggtggagaacatgcggaagccctgagtgatttgtcgaacagtcttgcaatatatttatatttaactttcattttgagcgcggtcccggcggcaatccgccggttggccgcgccctttttcgtaggggctgacgtcccagggcagcctctcttgccccccattgggacattcactgtccatcggcctacacctgtaggggcggcctttatggccgcccgcgggcgaccacaagggtcgcccctacgccgtgatgcgttgggacgggcgtccccctagcgtaggggccgacgccccagggcggcctctcttgccccttcggggcaattcaccttctgcccacatcggcccgtcttgtgccgagctgacgcaccttccatgttgccctttttgacaactgctttcttgttatgcctccggcgggcccctcggtggttccctcctcgcggcaaagccgctgcggcctacgctacaaacgtgccactggcacgtttgctttacgctgcggtttcgatttccccccttcccggcccccatcccccttaaaacgaccaatcaggggggctacggcccccctattggatgtaccccccggagctgctcgatcggcggctttccggcggcgggggcttactccgtaacgcccccgccgcaccggcttgtatgcggggtggctggaacgtaggggcggggcttgtccccgcccgcgggcggccacaagggccgcccctacggatggcatgagccgccttttctgcattttatttaacgttaaattgcaaaattcggcgcagctccccttgtttcccggccagagcggtttctccggccgggcgtttttctcccattgacagaatccttgcagggctcttataatggcggtgacaaacagcccaaaaactgcaaggaagggaggccgtcttttgaaacagcttctggcgcccctggtgggggatgcctcgccggtgacggtgattggtctctgtaaaaacgcgggcaaaaccaccgccatgcgccgcctgatggcggagctgggggaggagtgcctgggcctgacctcggtgggccgggacggggagtgcaccgacctggtgacgggcacggagaagcccgatctgtacctgaaaaaaggcgatctgttcgccacagcgcggggtatgctcaccctgtgcgatgccacgctggaggtggtggatctcaccgacgtgatgacccccctggggccggtggcggtgttccgcaccctgtccgacggatatgtgcagcttgccgggccgtcggcggccgggcagctccccccgctgacccgccgctttcaggagctgggcgcccagcgggtgctcatcgacggggccgccgggcgcaagagtctggcgggggccggcgtggagggggtggccctgctgtgcaccggtgcctccctggaccgggacatggagctggtggtggcggagaccgcccacacctgctggctctttgcccgcaaacggccagaaagcgccgccctctgcgccgccctggacggccaggaggcccgcttcgccctgtttaccccggagggggagccggtggagctgcccctggaggagagcggcgcccccaagtggaacaagctgccccggcggcccctggtgctctgggcggcggggggcattatggaccccctgctgaaaaccctggcccggcggggcgcccccaccaccctggtggcggcggacgccacccacgtgctggccggacgggcggcgctggacctgtttctgcgcaacggcggcgagctgcgggtgcgccgggagctgaccatcgcagccgtgggggccaacccctggtcggcctacggctggcattttgaaccggacaaattcgtccgcgccctccgggaggtcatcgacctgccggtggtgaacgtgaaggaggactgagcatggaactgacccatgaactgcgggagaacgcgggactccagtgggtgctggagcgcctgagtcccctgtcgcccttcggcaagcaggccgcccgcaccccccggtggtacggccccggcgaggaggccgccctggaggaggagctggacaacgtggccctggccatggagctgtgggccgccggcggcaccgccccccaggcggcggagagctgcggctgcgaggctccccgcgtgaaccccgccgacctcaaggacgcggcggcggccctgcggggcgtgacccgctgcctgcccctgtttcacgacatccgcggctccttcgaccgggagcccggtacccccttcgacctggtggagctcttcgagatcaagcacttcctggtcaccatggagcaggtcaccgacgcctacgccaaaatgccggcgctggcgggcatagccttcccgcccctgacggaggccatggcactgatggacccggaggggcggcggctgcccaccttctccatcgtcaattcctaccacaacgacctggcccccctgcgggtggagaaggccaagctggagaaggccatccgcatgacccaggaggacaagcgcggccccctgctggagaagcgccgggtgctggccgtacaggaggatcagctggagctggaggtgcggagcatgctcacgggcaggctcatggcgtggaaggcggaattcctggccaacatgggggccctgggccacctggatctgatcgtggccaagggcaagctggccctgcgttaccactgtgtccgcccctccctcagcgccgataaatccatcgccctgcgtgaagtcgttcacccccaggtggcggaggatctggcggagcggggggagcagttcacctcgctggatttggaactgcgccccggatgtaccgtcatcaccggagccaacatgggcggcaagacggtgtccctgcgctccaccgtgctctccctgcttttgtgccagtgcggcttcttcgtattcgccaagtccgcctccctgcccctgttccaccgggtggatctcattctggccgacagcggcccgggggccggcggcctgtcctccttcggcaaggaggtccacctgctggacaccctgctgcgccagaccagggactgctttttcttcgtggccatggacgagttcgcccggggcaccaacccccaggagggcgcggccctggcccgggcgctggtgcggtatctgggcaccctggactgtgtggccctcatgaccacccactacgacggcgtgtccgacgtggccggggcccactatcaggtggccggcctggtgcgggacatccagggagacgagggggacgacccccgcaagcgcatcgcccggcggatggactaccacctgctgcccgccccgccgggagccccctgcccccgggacgcccttcgggtgtgccgcctgctcaagctggacgacgccctgatggacctgtttcaggccgatctataacggccggttttgtacgctggaatgggggtttttctccattccagcgtactttgaagcgcggaattaaattttcgtaaaaatagttgacaaatttaactctctggggtatagtgttgttgtcaaaaatgaataatacgcatggatagaggcgcggagcgcaaggtagcgggacaatgacaagggcaggcgagcccgatgtgtcacgtgaatgtccgctccgccgaagggggatgtgaatcgtacagccctccccctgagccgtgggcccagtgcttgcggattgtcatgaagtaacatgaagcgctatttgtgtctgacggaagccccagggctcccgcagatgcaagtagtgtttttttgtgcatgaagcgctatcacgtctaggagggtcccatatcttcacaggcgaggtagtgttattttttcgaggaggcgtgttatggaaaagcttatcatcaccgcagccatctgcggcgcggaggtcaccaagaagcacaaccccgcggtgccctacaccgtggaggagatggtgcgggaggccaagagcgcttttgaggcgggcgcggcggtcatccacgtccatgtccgcgaggacgacggcacccccacccaggaccgtgagcggttccgcgtggtgctggacgccatcaaggaggcctgccccggcgtgatcctgattccctccaccggcggcgcggtcggcatgaccgcagaggagcggctccagcccaccgagctgttccccgagatggccactctggactgcggcacctgcaactttggcgacgacgtgtttaccaacgacatgcccaccatgcgggccttcggcaagcgcatgatggagaaccacatcaagcccgagtatgagtgcttcgagatcggccacctggacaccgtggtgaacatggccaacaagggcgaggtccccggcgcccccatgcagttcaattttgtgctgggcgtctccggctgcactcccgccacggtgggcaacctggattacttagtcaagcagatccccgccggttccacctggaccgtcaccggcgtcggccggggcgcgtggcccatggtggccgcgggcatcgtcatgggcggcaatgtccgtgtgggcttcgaagataacatctacctggagaagggccacaaggccgcctccaacggcgagctggtggagaaggtcgtacgcctggccaaggagctgggccgtgagatcgccacccccgacgaggcccgaaagatcctgtccctggcataatttttgttgttccaatctccccaaccatacatcgttaccccaaactccccaaccaaaccaagaacgaaacaggaggaactttctatgcagaagaaaggcaacaagtacggcactcaccgcgtcatcgagccccagggcttgctgacccaggcggccaagaagatcgacaacaccatggagtgctggtccaacgagatcctgtgcgacgtgtccgcgctgaatatcgactccgcctccttcacccagatctatgaggcctgcgggaaggacctgggtaagaccgagcagatgatcctggacattgtcaacgagcgcggcaagatgcagaaccctgtcaccggctccggcggcatgttcatcggcaccgtcaaggagatcggcgaggatctgcagggcaagatcgacctgaaggtgggcgacaagatcgcatctctggtctccctgtccctgactcctctgaagatcaacaagatcaaggccatccaccccgagatcgaccgcgtggacgtggaggcccaggccatcctgttcgagtccggcctgtacgccaagctgcccgacgacatgagcgaggagctggccctggccgccctggacgtggccggcgctcccgcccagaccgccaagctggtcaagcccggcgactccgtgctgatcctgggcggcgcaggcaagggcggcatgatgtgctgctacgaggccatgaagcgcgtcggccccaccggcaacgtggtggccctggtcatctgccaggaggacgccgacctgcttaagagcatgaacctgtgccaccacgccatcgtgggctccgccaccaaccccaccgaggtgctggagaagtccctggccgtcaacggcggcaaggagtacgacgtgtccatcctgatcgtcaatgttcccgcctgtgagatggccgccatcctgcccgtccgcgacaacggcaccgtctacttcttctccatggccaccgacttcgccaaggcggcgctgggcgctgagggctgcggcaaggatgtcaccatgattgtcggcaacggctacaccaaggatcacgccgagatcaccctctccgagctgcgtgagaatgcccagctcaaggagtacttcgagaagaagtacctgtaattgaaccactgtcccaatcatctgtgacatttccgctcctgtgcggctctgccgcaggcggaccgggggactctctcctccccaacccttccccccccgccgctgtctccgccgcacggcccgcggtttccatgtctccccaatctgatttagaaaggatgaccttgtttatggtagagtcccgccgtaaaatcctgttccccaacgtcaccgacgaggagtggaacgactggcactggcaggtcaagaaccgcatcgagaccctggaggacctgaagaagtacattgagctgactcccgaggaagaggaaggcgtcaaggcctgcctgggcaccctgcgcatggccatcaccccctactacctgtccctgattcagcccggcgatccccacgatcccgtccggctgcaggccatccccaccgccaaggagctgcatcaggccgactccgacctgctggaccccctgcacgaggatgaggactcccctgctcccggcctgacccaccgctatcccgaccgctgcctgctgctgatcaccgaccagtgctccatgtactgccgccactgcacccgccgccgcttcgccggccagaacgacgccggcctgcccgtggatcaggtcgaccaggccatcgagtacatccgcaatacgccccagatccgcgacgtgctgctgtccggcggcgacgccctgctggtgagcgacgagcgcctggagtacatcatctccaagctgcgcgagatcccccacgtggagatcgtccgcatcggctcccgcacccccgtcgtgctgccccagcgcatcactcccgcgctgtgcaacatgctgaagaagtatcaccccgtgtggctgaacacccacttcaaccaccccaacgagatcacccccgagtccgccaaggcctgcgccatgctggccgacgccggtatccccctgggcaaccagagcgtgctgctggccggcatcaacgactgcgtcttcaccatgaagaagctggtcaacgagctggtcaagatccgcgtgcgcccctactacatctatcagtgcgacctgtccatgggcctggagcacttccgcacccccgtcagcaagggcatcgagatcatcgaaggcctgcgcggccacacctccggcttctgcgtgcccaccttcgtggtggacgccccgggcggcggcggcaagacccctgtcatgcctcagtacatcatctcccagacccccaagaaggtcatcctgcgcaactacgagggcgtcatcaccacctacaccgagcccgagcactacaccgactgccagtgcgactactgcaccggcaagaagaagaaggagctcatgggtgtggccggcctggagcgcggccaggcgttgtccatggagcccgccaacctggagcgtcataagcgctcccatcacgaggaataatcagggaatattcccaagcgggccgctgctttgacagcggtccgcttccccctgcttttgactgaaaccgagaatggaagtgattattgttggaatccaagctgaatcttgatttcaagctggtggagcaggcccgggcccacgccgcccgcgtggccgacgacacccagcgctttatcgacggctgcaccaccgtggctgtcgagcgcaccatctgccgcctgctgggcattgacggtgtggacgcctccgatgtccccctgcccagcgtcgtggtggaccacctgatggacaagggcgcgctgccccagggcgccgccttctggatcggcaacgccatggtggagaccggcaagggtccccaggccatcgccgaggacgtggccgccgacaagctggagctgaccgagctgcccgtccacagcgaggcggacatccacgccgccctggctcctatcgtggaggagagcctggccaagatccgcgcccgccgcaagcgccgcgaggacttcattgccgcccacggcggcgagaagcagggcccctgggtctacctgatcgtggccaccggcaacatctatgaggacgtggtgcaggccaccgccgccgcccgccagggcgccgacgtcatcgccgtcatccgcaccaccggccagtccctgctggactacgtgccctacggcgccaccaccgagggcttcggcggcacctacgccacccaggagaacttccgcctgatgcgtgaggccatggacaaggtgggcgaggagctgggccgctacatccgcgtgtgcaactactgctccggcctgtgcatgcccgagatcgccgccatgggcgccttcgagggcctggacgtcatgctgaacgacgccctgtacggcatcctgttccgcgacatcaacatgcagcgcaccctggtggaccagtccttctcccgcgccatcaacgcctatgcgggcgtggtcatcaacaccggtgaggacaactacctgaccaccgccgacgcggtggaggaggcccacaccgtgctggcctcccagttcctcaacgaggccttcgccctgcgggccggcctgcccgaggagcagcagggtctgggccacgccttcgagatcgaccccgatgtggagaacggcttcctgtatgagctggcgcaggccgagatggcccgcgagatcttccccaaggcgcccctgaagtacatgccccccacgaagttcatgaccggcaatatcttccgcggccaggtgcaggacgccctgttcaacatggtgactatcctgaccggtcagaagatccacctgctgggcatgatgaccgaggccatccacacccccttcctgtccgaccgcttcctggccattcagaacgcccagtacatcttccgcaccatgcacgacctgggcagcgagattgtcttcaaggacggcggcatcatgcagaaccgcgccgccgacgttctgaagaaggccaccgatctgctggcccagatcgagcagctcggcatcttcgagaccctggagcggggcatctttgccgacatcaagcgcccccgcgacggcggcaagggcctggacggcgttgtcaacaaggctgctgggtacttcaaccccttccttgagcccatgatgaaagggggtgccggcaaatgagctccggactgtatcagattcgcgataaaaacctcgacacaaccctggacctgacccgcctgaagccctatggcgacaccatgaacgacggcaaggttcagacctccttcaccctgccggtgaaggacgacgacaagggcgcggccgcggccgtcatgctggcccagaagatgggcctggccgaccccaacgtggccctgcgccagaagctggacgagaacttcaccttctacgtggtctacggctccctgacccactccatcaactacaatgagatcgtggtgcagaccgtcaccgacgagaccatggacatgcacgagaatgatgagttcctcaaggagcgcctgggccgcaagatggtggtcatcggcgcctccaccggcaccgacgcccacaccgtgggcatcgacgccatcatgaaccgcaagggcttcgccggccactacggcctggagcgctacgacatgatcgaggcgtacaacttgggctcccaggtgcccaacgaggagttcctgcgcaaagccgccgaggtcaacgccgacgtgctgctggtctcccagaccgtcacccagaaggacgtgcacatccagaacctgaccgagctcatcgagctggccgaggccgagggtgtccgcgacaagtatatcttctgctgcggcggcgcccgcatcacccacgccctggccaaggagctgggctatgacgccggcttcggcgcgggcacctacgccgacgacgtggccaccttctgctccaaggagctggtccgccgcctgggcaagtaagacgtattctcctctctttcctctttttcccaagcgcacagccgccggaactttacagttccggcggctgtgcctatcgaacttatttcgataggcacaggcacttttcagaatgaattcattctgaaaagtggtttgatccaacgcgaacggcccaggccggtctctcttggcctgcggccaattcacctccagggaaccctgacggttcatctccgcaccaagcgccgccgcaaggcggcgcttgcgctccgaatcgccctgcggggcagcctttcacacgatccttctctcccaaatcattcccatggcaatggagccccacccaagctgccggaaccttgcggttccggcggctgtcttttattctccctttttgtcgcccatctttaaggatttttaagaagttcttccgcctttcttttctccgccctgttatccttcttattatataaggtaaggaggcattggatatgcacattggaacccgtcttggggcggccggtctggccgccgcgcttctgctccccaccggggctctggcggccggaccggatcaggcccaagcccgccaggaggatctggacacgctgtacgcggccctgcaggagcaccaccccgacctgtacgccaacaccccccaggaggcatttgaggcgaaaaaggcggagattgagggccgtctggcggaggagagcgacgtggactttgccctggatctccagagcctggtggccctcatcggcgactcccacaccaccaccaatatcggctccgttctgaacagcaccggcctgtaccccttcggcgcggagtggtatgacggaagctgggtgctcactggggcggaagaggaggatgccgccctgctgggccaaaccgttaccgccctcaacggcgtgcccatggacgagatctgcacccgtttcggcaccctggtgagcgccgacaaccccgtgaagctccgccgccagaccgagcagctcctctactcggaggcctgtctggactatctgggcatcgcggagtccggcgaaccgctggaggtgaccacctccggaggctccttcaccgtggaggccctgcccatggaggacttcggggacgccgccctgtccagcctgtcccagcagcgggagagcacgcctgccaccgcctaccggaagggcacctactactttgcccagtccctggatgacaccacctattacattcaatttaaccagtgcatggaggaccccaagcagcccatggacggctttgccgcccaggtggaggccgagctggaggcgggagactaccgccaggtgctgctggatctccgcaacaacggcggcggctccgacggcgtgctggtccccatccttatgctggtgcccggcctggtggaggagggcgtgaaggtctacggtctggtgggcgaggccacgtactcctccgccatcatcaacgccgtagagctggtggacgccggcggcgtgctggcgggcagtcccaccagcggcagcgtcaaccacttcggctccaccggctccttcaccctgcccaactccggcatccgggtgagctgctccagcaaatacatcgacctgggcacactgctggaggccgggctgggggcccaagtggagcccctggtccccacggtccgggtggagcagaccctggacgactatctggccgggcgggacaccctggtggactggctgctggccaacggcgcggactataccgcccccgagcagcccgacgcccctctcacccggggccgcctggcctggatgctctggcaggccgccggcgccccggaggccgagcccgcccccttctccgatctaatgcccttcgcctattatgcccccggcgtgggctggtgcgaccagaccggcgtagccaacggcgtgcccggcggggccttccgtgcctcctgcgccgtcaccctggaggaggccgcccagatgctggtccgtttcgtccggcagcaggggctgaccccggcagaggtgcgctctggtgcccccgtcctcgcctccgatcccgccccctgggcatcggagtccgtggcgcaggcgtggcgctggggactggtggcggagggggccgatcccaccggggtcctcacccgcgcccagggcgaggcgctgctggcacggctcacctcctgaaagggcagtcaaatttctggaaacagcgtcgactttttccgttccctgtggtatgataaggatatccacggcaggcacgctccggcgtacctatgcccttcggaatgggaaaggagatcatgtgatatgaggaacaaacggttcggcaagctgctgtccgccgctctggcggcagccatggcgctctccctctcctctgccgccctggcggccgggaacggcgagacccatctgaccatcatcggcacctcggatacccacggcaatatctggggctactcctacgaggacatgaaggagagcaccggagacggtctagcccgggtatccgcctacgtcaaccaggtgcgctcggagaaccccaacaccattctggtggacgcgggcgacaccatccagggcaccatcatgaccgacgacctctactccaaggacaccgccagccacccggtggccgccgccctcaactacatggactatgatgcctggaccctgggcaaccatgagtttaatttcggtgtggacactctcaagtccattctggagcaggtggacatgccggtgctggcggccaacatcaagaacgccgacggcagctacttcaccggcgcgggctacactatcgtggagcggggcggcgtgaaggtggccattatcggtgtcaccactcccaacatcccccgctgggacggcaccaagcagggcgtggctgacctgacctttgagcctatggccgacgccgtggccgcttgtatccaggagatcggcggccaggccgacgtcatcatggtgtccacccatgccggcctgggagccgagtactccgccgacggctccgatgcagcccagaccatcctggacaagtgccccgaggtggacgtgctccagttgggccacacccacaccacttacatcaacagcgcgcccatccctgtgggtgaggccaagaacaatgccggcgaggtggtgcgctacgacctgaccctcaacgccgacaaggagatcacctccgccactgtggagaccgtatccatggagggcatcgagcccgaccagggcctgcgtgagctgcccgccgtcaagagcgcccaggaaaagaccgtctccttcattcaggacaacgtgctgggccatgcctccgccgacttccagccggtggacgagatcaagggcatcccctccggccgcatcgaggacaccgctgtcatcgatctcatcggcaccgtccagctggagaactccggcgccgacgtgaccgctgttgcgttgttcaaggacaccagcgacctgaaaaagggcgatctcaactacggcaacctgttcgacatctacaagtaccccaatgtgctctacaccgtcaaggtgtccggcgcggagatgaaggcttacatggagtgggccgccgcgtgctggaaccagtggaaagaaggggatgtatccatctcctttaacccgcagaagcctggctatctccacgaccacttcatcggcctgaactatgaggtcaacctgtccaagcccgccggggagcgcatcgagaatgtgactttccagggcaagcccctcaccgacgacatgaccctcaccctctgtgtcaacgactaccgctacaccggcctgaagaacgagggcatcatctccggcgagaaggagtgggagtcctccgcctccgtccgcgacatgctggtggcctatctggccgagcacgaccccctggagcccgcggtggaccacaactggaagatcaccggcgtggatctccagaaggacaacccggaccgggccaccctaattgagctggtcaataccggccgcctggagtccccctatagccagagtctcaacctggacacctactccgaggtgcttggcatggtggacaatgtaaaggtcagcgatctggacaagaccggtaccgccgcctcctttgtgggcgccgacggagccccctacttccgtatgcgggatctggcatacacctttaatggctccaagaaccagttcaacgtatcctgggccgatggtaaggtggccattaccaccagcacggcctatgacggagagctgttccccctgcccgtgcgcatccccgctgcggttcaggagcaaatccctgcggacatcaccgtatctgtggacggtacggacatcaccgtgcccgccattctctttgacggccactactacctgaccgtggacggcatgaacgccctgctgggcaccaacgccaccatccaggagaaggccgcctgatcctgttcctccccaagttccccggcggcattgccgccggggaacttttctgttacaatgacagggacacgagtgaagaaaggatgtgacgcccatggcgctgcccaagctgattgtggtgctgggtaccaccgcctgcggcaagagcgggctgggggtggagctggccaagcgcttcggcggggagatcgtctccgccgactcccggcaggtgtaccggggcctggatctgggcaccggcaaggtgacggaggaggagatggagggggtgccccaccacatgctggacgtggtggagcccaaccagccctattcggtggccgagttccaggccggggcctatgccgccatcgacggcatcctgtcccggggaaacacccccttcctggtggggggaaccgggctgtacgtccgggcggtgaccgagggcttcaccttcaccgacgcccggcccgacccggccctccgggcgaagctggagggaaagaccacagcggagctctacgccctgctgcgggaaaagaccggcgtcaccctcaccgacggggaggagttcaaccgccagcggcttatgcgctcggtggagaaggccctctccggccagtgggagagccccccgccccgcccccggtacgactgcctgctgctgggggtgaccttcccccgggacgtggtgtgccgccgcattgacgagcggctccaggcccgcctggacgccggaatggtggaggaggtggccgccctccgcgccggcggggccgacgactcctttttggaggggctgggactggagtaccgctatatcctctggtacctcacggggaaaatccccaccttggacgcgctgaaggacgagctgggccgggccatcaagcgctttgccaagcggcagatggtgtggtttcagaaggatcgggacgtgctttggctggacatggagggggactttctcacccaggccgtccaggcagtggaggattttctggcgtaatggtttcgccttttatcagaaaatctttaccaaatcgtaatcttctctccatggactctttcgcttttcacggtatactaagaggcagataccaagcaaaggagtcccagccatgtggaatttcaaatacaagaaccaatatctcaactatgtctccgatctgatgcaggacaccgccgtgcagtccatgcgcctgctgccccagcaccgggccggggtgagctgctaccaccacagcgtgctggtgagctacgccagttggcgggtgtgcgactggctgggactggacgcccgggccgccgcccgtggcggcctgctccacgatttctacctctacaactggagggacgccgcctcccatccgggtatccgccacggctcccagcacccggaggtggccctgcgcaacgccagggcccgcttctccctcacctggcgggaggaggacatcatcctctcccacatgtttccctatacccccaccaaggtgtaccgctgcctggaatcggcggtggtaagtaccatggacaagctgtgtgccgccgccgagctggtagggctggtgcccctgctcacccgcttccgccgggagacccccttctggctggacgccgactgggctcctaccccgctgcgcaaggccggctgattccaaggcgcatgtcctcggaaatgacggattttcattcgattcctgcggctgcggccgcaggaactctgcgaggctttccttcggggaaggtttttcgacagactgagcgccgcccaatgggcggcgcttttttcacccttttatggaaagtgcacttgacatacaggccctgctgtgctataacatagatgtaaagtcagctttccaaaggaggtgcacgcttgaagaaccggctggaggaactgcgcagggagcgggggatcacccaggaggagctggccgccatcctggaggtctcccggcagaccatcagctccctggagaaaggccggtacaacccctcgatcctgctggcctttaaaatcgcccgctgcttcgggcagagcatcgaggagatctttttgtatgaggaggatgcgcaatgaccaaacggagacggcagggctggatgctctttctggcggggctgctcctgctggccggggcctggctgctgctgaggctgctgcccggcctggataccaccccctggcgggcggtcccctttctatgcctgggggtgggctgcggcctgttcggcggcggtacaggggagctgctggccgttcaggccatgaagaagcacccggagctccagaaacagaacgagattgcggagcgggacgagcgcaacgtggccattggcaacgccgcaaaagccaaggggtacgacgtgatgaccttcgccttcggggctatgctcctcttctccgtcctcatggaggcggatctggccctcaccctggtgatggtggcggtctatctgttcattcagttctactccctgtggtggcgcttcaagctggaaaaggagatgtaaggatggaacccaaggaatttctggccttcctggccaggctggagaagctcaagtgcaatacccgccactcctggacctcctccgggcggcacgagtcggtggcggagcactcctggcggctggccatgctggccatgctgctgcgggacgcgctgccggaggtggacatggacaaggtgctgcgcatgtgcctcatccacgacgttggggaggcggtcaccggagacatcccctccttccagaagaccgacgccaacgaggaaaccgagcgccaggccatcgcagagctgctctcccccctgcccgacgggctgcggggggagctgaccgccctctttgccgagatggacgccctggccacgccggaagcccgggtctacaaggctctggacaagctggaggtggtggtgcagcacaacgaggcccccctggacacctggctgcccctggagtacgagctcaaccagacctatggcattcccgagaccgcccccttcccgcccctggcggccctgcgggagcaggcccggctggataccctggccaagctggcagaaaaacccggcggatgctgacgcatccgccgggtttcacgctagtccgctccgccggcggggggcagcagcttgcccagctccgccaccgcgctctccagcagccgggccacgggcagctccgccacgccggccaccaaattgtcgcactggttgaggggaatgagaatccgccgggcccgggcctgccctaccgctaccgccatggccggggagatctcccccatcagggcgtcggcgatgacgatgcccagggggcccaaaatcacatccgcccggcggcaggccaccagcagggcgttctctcccgtggccccctgagacgcgccgcccttgagcatggcggaggtggccaggctgttggttccgatggcggtcacctccacctggggatatcgggccagaatcgccttgatgagctgctgcccgatccggccgccctggccgtcaatcactaaaatctccatcgtttgaccccttctctctgtttccattggccttattataatctaccctggggcaggccgcaagcgccgggatgagaaaagtgcattccctttttccccaggctgtggtttaataagaacaggaactttcatccggggggaatggagatgctgtccaatctgctgacggtcaccggacaggtggccactttgtttttgatgatggcggtgggttttgtgctgggccgggcgggaaagataactgaggcgggccgcagccagatgtcgtacctgctgctctacatcgtctgtccctgtgtgatggtggactgctttctggtgaagcggacccccgccttgacgcaggaggttgcggtcggctctgcggcggcgctggcctgctatctgctctttttcgccgtctccctgctgttcttccggcggcagccggcggatgcccgggacaccctgcgttttgccgcggtctacggcaacatcggcttcatggggctccccctggtccagtccatcctcggggaggaggcgctggtctacggcgcgctggccctgctggccttcaacctgaccagttggacgctgggcgtgctgatcatgggaggccgggcggccttctccctgcgcagggcggtgctcaacccaggtgttatcggcatcgggctcgggctgctttgctttctcagcggcctgcgctttccctcccccgtgggagcggccctctccttcctgagcgacctgaacacccccctggccatggtggtcatcggtacccagctcgccgaagcccacctgcccagcaccttccgccaacccaggaactacctggtttccttcctgcgcctggccctgttccccaccctgactgccctgctgctgctccccctccgctcctcctccggcctctactgcgccctggtgctattgtccgccacgcctgtggccggtacgaccagcctctttgctcagcagttcggccgggataccgcccctgcggcggagtccatcaccctgtcaactctgctctccatcctcaccctgcccctcttcgccgtgctggccagagggatcagcatgttctaaccgtaagcgcagacgcggccgccccagatggggcggccgcgtttctatttgcgcaaaaacttcatgcgcctaaacctttgcacagtttcgtggtgccccctgttcacatgaagtttaatacctaaaacaggagtccccagagcaggaatccgccgcaggcgaccaggccagtaaagatcgtaatgatgaccagatagcccatgatattgcgggcagacaatccggcaatccccagagcgggcaaggcccagaatggctggatcatgttggtccactggtcgccccaggcaatggccatggcggcccggccgtactcgatgcccatctcagtagccgcaggcataacaatgggggcctgcaccgcccactgcccgccgccggaggggacaaagaaattgatgatgccggcggaaaggaatgtcagcaccgggaaggtgacattatcggagatttgggtgaagaagttggcgataattccggccagggacacccccgcatcgttctgcgccaccatcagtcccatgatgccggcatagaaggggaactggagcagaatgcctgccgctccggaggcggcatcggcgatggcatccacatacctgcgcagatcaccgtggagcaaaatacccaggaacagaaaaatcatattgacgatgttcagatccaggttgaaccccttctgcacaaagtaatacacgatgtacgcaaagcccagcacaagagtgataaaccacaggaccttattgtgctcaattttctccgccggggtattcatggtataagtcttctccgcctcgtccaccagtaaggctggatccaccgcaatggtatggtcggtatccggatgcatggcatagttgacgaagggcatgagcaccaggatgacaagtaccatgaccaggttcatcgggtgaaatatagtggcagtaaccggggcctggtatacaactccaagcacctcggagcccgtgccgccaatttgcagagggatggaccccgacaggccggcgtgccagatcacaaagccggaataggcggaggcaatcagcaggggataatccacatcccgtacccggcgggccacagccttggccagcagggcgccggcaatcaggccaaagccccagttgagccagcagcagatggtggacacgaaggtggtaaccaggattgcgctctttttgtcgtgagccaaggtggcaatcgctgccagcgccttcttgcacgccttggcggaggccatggcggagcccagcaccagcaccagggccatctgcatggcgaaggacagcaggctccagaagccatccttgacttcgccctggcccccccaggaccacaccaattccaggggaccctgctgcgtaccgatcatggcagcgataaagaccacgatggtcaggatgatggcgaacaggaatggatccggaagccaccggttcacaacctgcacgcagccattggtaaagcgtttgaacatgaaacaacctcctctgtatctctctccgccacatacactccatggcaggaactgtctaaatcatagcaacctacttctgtcgtgtcaataaaaacctataagtctagtataaattctacaaagccatattgagaaccggcaggtttccttctcctaccatcctcatttcttcatggacatacccaggcccccaccgtcttctacgggcggtgagggcctgggtatggggtttgcagttattcgaagggcgccatctcccagcggataaagtagccctgtggatgcttgcagacggggcacacggcgggagccatggtggcgtcgataatttggccgcagttgaggcacatccacttgacctgaacatcggacacaaacagcttgtcctgctccagcagctcagcaaacttgccgaagcggtcgccatgggtcttttcaattccggcaatcatggagaaaatgtgggcaatctccgggaacccctcctcctgggcggttctggaaaagcccgcgtagtcgtggtcccactcctggtactcattgtgctgggccgagcgaaggtggtccagaatgtcgggaaacagctctacggggtaggtgccgtccacctgaaggttctgaccggacacctgctccagcaggttgtagaacaccttggcgtgggcccgttcctggtccgcggtgaaggtgaacacgctctccagtacatacaggttcttccttcgggccagtccggctgcgaaggtgtagcggttgcgggcctgactctcgccggcaaaggcccgcatgagattgagtctggtttcactttgtgcaaaatcagcggacataaaaatccctcctgttttatggataccgtaagcatatccacaaccagaaaaaaccatacaaaaaagtacagcaaagttctccggcggttagcacagcacagagcatacggactcgaaacccctgagcgggatgtttctttgctctcaaaccgtgttctgtttcgacaggtcttctgatttatcggattccctgtggaaatttttccattcctatggtatactgaaaactgatttaatccacgaaacaggtagggatacacggtgaaagagcgcaatgtaatgtttaccgagactgattttagaattctggactcttataaatcggtgctggatggtctggctgcttaccttggggatggatacgagatcgtattgcacagccttcacgatttggaccattccgtaatcaaaattataaacggtcactatactggccgacgcgagggcttccccatcacagacctggctctgtccatgctggcaaaaatcgaggaacggcccgacacaaactgcatcacttactttaaccgaaaccagaaaggcgaaccccttaaatcggccaccattgtaattcgcaatcatagccgcatggctatcggcctgctgtgcatcaacttttacatgaacacctcggtgtttcaatttctgcagagtatgactccgcccgccgcacagactccggattctcccgtggaggagagctatgtagagaatgtggatgaactgattgtccaggcggtgaccgaagccagccaaaaggttcagaacgacagcgccatttcaaacgccaacaaaaacaaagagattgtcagtattctttaccagaggggaatcttcaacctgaaagatgcggtcgtcaaggtcgctggcctcatgggtatctccaagaacacagtttatatgcatgtacgcaatctcaatcacggctgaaaaaggctggaaccggtttggttccagccttttttataatcagggctttttgtggagaatcgcgccgtccgggccctcataaatccggtcccacccggtcaggatcgatacggtcagcacaacaaagaggaccatgggatagaacgccccactgaaaatctgcagcggggtcaccgcaggcagataggagtactcctccagcagcggctcaatggacgaggccgagatgaagatgaaggcgctgataaaagggaggattgcggggaaggtgttggcgtagcctgtcaggaaattggcgcgccggtaggggtgaatctggtgtctggcgcccagctcatcagccacggagccgaaggtaagtaccgaggcgctggtcacacctcccaccaacagggtggtaagcatggagcccagcccaatgagcagctcagccccgcgggccgtgcgcgcaaaccggctgttgcagatgccttgaatcatgcgctccatcgtgccgctctcgttgagtacgcccatggcgccgaacagggccatgcagaacaggcagataccgatcatgccggtaaagccgttatagataaagccggtggccgcgccgttctccacccccaggatgtcagaggggccgaaggtaccggagagcaggcccacggcaatgcccgagacgaggcccgccgtgacggccttgaagatatcgcgggtgcggatcgacacaaacagcaggacggccactgggatgagcatgatgaggcccttgggatccatgttggcctgaaggatctcatccgccccttccatgactgcgccgctgccgccgccgaatacggcgaagagtaccaacgcgatgccgccggcgatcagggcgtatttcaggcggtaacccaccgtgccggcgatatcggcataaccctccttggttcggaaccgttggttggttgtggatgcaatggtcacatcagagatgggggccaggttatcgccgaaaattgcaccggagaggatcgcgcccgccaggattgcggggtggctgcccagcaggattcccgccggatacaggatgggaaacaccgtggtcagggtcccgatggaggagccggtagccgtggtaatcagacaggcggccaggaatgtaaaggccgtaaagatgctgcccggcataccgaccatgtgtgccatccagacaaagccctgggataccccgctgatggccatcagcttggtaaacataccaatgaccagcaggatcaccacaatacttacggaggtggagcttccgattccacgcagcaccgcatcccagtaggcaccataggttttgcaaaacagcgcgcctatcagcagccccaggaagccgcccaccgccagggcgttcatatcaaagaccttgtagcccacaaaatagaccacacagaataccaggaaaataagcatgggtacaacggaccaccactgtccgccccggaactcaaccggatatctctttctctcttccattgctcaggaaacccccttctcctttcccagcttcatgagtgcggctttgacacgctccagcgccgtcaccatctgcgcgtcctcccggaaggctccgaatacaatccgcaggtgtccctccccttgtgcgccgtacggggtgccggcgttcaccaccacgttggcctccttgatgatgtaggcgttgacctcgtcggcggtgccgagccgggacacgttcacccagcagaggaaggtgctctccggcatggccatggacacaccgggaatggagttgaagatctcataaacgattttgcggcggcggtcaaagatgcggttgtactcctccaggaaagaggcatccttcaacgcagcaatggctcccagttgagaggcggtgttggtggctccgatcacgcttacggcgctgccatagtacacatccatgatgtggtcgtccgccacgatgtaagccacccggtagccgctgagcgccattcccttggagatggagcataccgtgacggtgcgttcccacatgcctggcagggacgcaagggtgacaaactccaccccgtcgtacaccgagtcctcaaacgcttggtcgcacaccacaatcaggtcgttcttaactgcaaattgggccagcttctccagactctctctgcgcataacggtagtggtggggttgttggggttggtaaggacaatcattttggtgtttggcgtcaggcgtttttcgaactcctcgatctccagttggtatccgttctcctcccgcagggggaccggcaccgttacaccgccgaggattctggcgttcaggaagttgtttggatagctggggtcgggcaccatgacctcatcgcctgggtcaatgaagggcatcattgcaaacatcaggccggcatctgaaccgggtgtaataattatgttgcgctccggggccacatccaggtggttgaatgccttgagctttttcgccagttccattttcagctccatgttgccgatgggcatggtgtaatgggcggatgtcccgtcctccagccccgccagagtagcccttttcacgtgctccgggatcgccgggtcgggatagaaggggtcggcccagcacatcagagccgcgccgttggcaatgaggtcgttcaatgccgttcccacatcggctttggagactttttcaaacagtcccccctgaattccccggaactttttgctgatcttatcctggacgctcatattccatactcctttctcttctgctttacggcaaattccggtccccaatcatatataagcggctgtcagtccagttcggcaaccgcctcaatctcacacagggctcccttgggcagatccttcaccgccacacaggagcgggcaggcttggaggtaaaatacctggcatatacctcgttgaaagcggcaaagtcggcaatgtcggccagaaagcaggtggtcttgaccaccttttcaaaaccggagccagcagcctccagaatagcgcccacatttttgcagctccactctgcctgggcggcgatgccttcgggcatggccccgtcggcgggattcaccggaagctggccggaggtaaacagaagctttccggtggaaatcccctgggaatagggtccaatggcggcgggcgccccttttgtctggataatgttcataagaaatcgtcctcctctatttttgattctgtgcagattatatcactgaaatttattttagtcaatgcatttttctttatttcaaaaaaaccgtcctccctcgtacgagggaagacggtttcgggaacgctcccgcgatttgaattacagcattttctccagctcggtccggatggcccggatgaactccagggaggtgacacccctggcggggatctccccatcccacaggcccaccagatcctttgtcatggtgcccccctcgatggtggcgatggcagccgcctccagcttgtcggcaaactgccccagagcgtcaatgccgtccagctctccccgcttgcgcagggcgccggtccaggcaaagagggtggccaccgggttggtggaggtctcctcccccttcaaatacttgtagtagtggcgggtgacggtgccgtgggcggcctcatactcatatttgccgtcggggctcaccagcacagaggtcatcatggccagggagccgaaggcggtggaaaccatgtcgctcatcacgtcgccgtcgtagttcttgcaggcccagatgaagccgccctgggagcggatcacccgcgccaccgcgtcgtcgatgagcgtataaaagtactcgatgcccaaggcgtcgaaggcggccttatactcggcgtcgaagatggcctggaagatgtccttgaaggtgtggtcgtactgcttggagatggtgtccttggtggcgaaccacaggtcctgtttggtgtcaatggcgtactggaagcaggaacgggcgaaggaggcgatggagctgtccttgttgtactgcccctggagcacgccggagcactcaaagtcgtagacggtctggcggaattcctccttcccgtccgcgccggtgaacaccagctcggccctgccggggccgggcacccggtactcggtgcacctataaacgtcgccgtaggcgtggcgtgcgatggtgatgggatgcttccaggtcttgaccaccggggagatgcccctgaccatgataggggcgcggaacacggtgccgtccaggatggcgcggatggtgccgttgggagacttccacatctgggagagccggtactcctccacccgctgggcgttgggggtgatggtggcgcacttgaccgccacgccgtacttcttggtggcctcggcggagtccacggtcacctggtccttcgtccgctcccgctcgggcaggcccaggtcgtaatactcggttttcaggtcgatgtagggcaggagcagctcgtccttgatctgctgccacagcacgcgggtcatctcgtccccgtccatctccaccagcggggtagtcatctgaatcttttccatggtctcctcctcggttggttttatcgcatttcctgggccaaattatacccccatccgtcaaaaatggcaagggattccgtgtgttttgcctcttgtcccgcccgggttggatcggctatactggaacacagccacaaagagaaaagaggattgtcccgtgttcagcaagcaggccctgcgcaggctcattctgcccttaattatcgaacagtttctggccgtcatggtgggcatggcggacatcatgatggtctcctccgccggagaggccgcagtctccagcgtggcgctggtggatctcatcaacgtcctgatcatcaacatctttgccgccctggccaccgggggcgcggtggtgtgcgcccagtccatcggcgcccaaaacctggagcgggccaaccgggcagccaaccaacttctgtatatcgtcaccgccgctgccctggggatcatggttctggtgcttttctgcaaggcagggctgctgggcctgctgttcggccaagtggagccggaggtgatggagggggccgtcacctactttgtcatctccgccctctcctatcccttcatcgccgtctacaacggctgcgccgccctgctgcgggccatgggcaactccaaggcctccatgtgcgtctccgcctacatgaacgggcagaacattgcgggcaacgctgtctttgtgttcgtgttccaccagggtgtggcgggcgtggccctctcctccctgctgtcccgcatcgcggccgccggactcatgctggccctgctccacggccggcgcaaccccgtgcgggtgtccggcctgctccgcttccgattcgaaccggcggtcatggcacagattctccgcatcggcgtgcccaacagcctggaaaacagcttctttcaactgggccgggtgctgctggtgagcctgatctccaccttcggcacggcccagaccgccgccaacgccgtggctaacaacatcgacaatttcggcgtcattcccggccaggccctgggccttgctctcatcaccgtggtgggccagtgtgtgggggccggagactgggatcaggtgcgcgcctacaccaagcggctggtcaagctcacctacctgtgtacctgggggctcaacgctgcgctgctgctgggtctgcccctcatcctgcgcctctacagcctgacgccggagacccagtggtacgccgcggtgctcatcttcatccacaacggctgcgcaatgctgttttggcccctggccttcaccatgcccaacgccctgcgggccgccggtgacgtgagggtgcccatggtcatttccatcacctccatgcttgtggtgcgggtggggggcagctatctgctgggcctccacttcggcctgggcgccatcggcgtgtggctggccatggtgggggactgggtcgttcggctcatctgcttcgtgctccgcgcccgaaaaaagctgtggctggagcaccgctgaatacgcgcacccgaagccattcgggtgcgcgttttctttaccagaggcccagcgcgtactgcatgcccaggctcactgccgtgatggccgcccagcagcacaagcccatcagaatgggtctgccgccggtcctaacgagtttgatcagatcggtattgagcccaatggccgccatggccatgatgatgaagaacttggacagctccttaaaaggagcaaaggccgctgcgtccactcctgccagggacgcccccgtagtaatcagagaggccagcatgaagaacagcagaaagaaggggaacacccgccggagagagaagcttccctcccccgcgccgcctgcccgcctggcccgggcggtgcgccggagagccagcgccagggtgatggggatgatggccagagtgcgggtgagcttgacaatggtggcggtgtccagggtgttggccccggggtgcattccgtcccaggccgcggcagcggccgtgacggaggaggtatcattcaccgccgtgccggcaaagagtccgaagccctcgtttcctagacccagcaggccgcccagggtggggaacaggagggcggccgccacattgaacaggaagatgaccgagatggactgggcgatctcctcgtcgtccgcgccgatgaccggggcggtggccgcgatggcggagccgccgcagacggatgagcccactcccaccagggtagagatgttggaggggatatgcagcagcctgtgcagaaggaaggacaccaccagggaggtggtgatggtggacaggatgatgggcagggactgaacgcccaccttggcgacctccgacagattcagtccgaagccaagcaggatcacggcatattgcaggattgtttttgatgtgtaggcgatgcccgcctgagcccggcccttatcccggacaagcagggcgatagccatgcccgccaggatggcgaacaccggcccgccgatgaccgggagcgcccggcccagcatccagcagggaatggcgatgcacaggcacagcagcagcccggtccctctctcgttccagtgcttcatgtcatacttcctctctttcggatgggttcccctatcataccgtaaaatttccatcaggtaaaatgatacttatttatttttctataagaaatatttattgcttctttcccccgtttcctcccttgcccccggagcgcttttcctgtataatgtggtacagtattgcgcaactgcgtggaaagggagcctttttatgctgcaaacggtcattccacaggggtacgccccctgtctgaacctctatgacactcaaaaggccattggcctgctcaagcgcctgtttgaggatacgctgggcggcgcgctgcacctgcgccgggtctccgcccccctgtttgtggaggcctccaccggcctgaacgacgatctcaacggcgtggagcgggccgtctccttcgacattcccgacgccgggcgggacgcacaggtggtccactccctggccaagtggaagcggatggccctctaccgctaccagttctccgtgggtgagggcctctacaccgatatgaacgccatccgccgggacgaggagctggacaacctgcactccgtctatgtggatcagtgggactgggagaagatcattgccccccgggaccggaacgccgactatctccggcaaaccgtgcgcaccattgtctctgccatggcagagacccagcacaccctgcgctcggtctttccccaactcaccgctcttcctccgctggggacggaggtctccttcgtcaccacccaggagctggaggagctctggcccgaccgctcccccaaggagcgggaggatgcctgggtgaaagagcatcccgtcaccttcctgatgggcatcggcggcgcgctcaagtcgggccgcccacacgacggccgggcccccgactacgacgactggaccctcaacggggatatcctggtgtggaacccagtgctggagcgggcttttgagctgtcctccatgggcatccgggtggacgccgccgccctggaccgtcagctcaccctcgccgggtgcgaggcacggcgggagcttcccttccacaagctgctgctggagggcaagctgcccctcaccatcggcggcggcatcggccagtcccgcctgtgcatgctcctgctgggcaaggcccacatcggcgaggtgcaggccagtgtctgggatgaacagaccatccaggcctgccgcgacgccggggtaattctgctctgacgccgattgggctttgcccaggcccgcgcctttgggcgcgtccaagcgttttgctctgcaaaaccttgatgccggggcgattcattcgccccgcgcagataaaatctgtggggtccccgcccggccacggtcgggcggggctcaaggcccacatcggcgaggtacaggccagtgtctgggatgaacagaccatccaggcctgccgcgacgccggggtgattctgctgtaacgccgcgtccggcttttggtaaaagtggaacacggggcggcctatgagtgggccgccccgcgtctgcctgcggtgcaaaagtgcttgtacgctctcctccggctatggtacactagcaggcgaaccgaatctttgcacacggaaaggaccaccatggatattttggagcaaatcagggccaattacggctccttcagccgccccaggcagcgtatctccgactttatcctgaattacccggagcagtgctgctttctctccctcagaagctttgcccagcaggtcgggaccacggaggtcacggtcctgaacttctgccgcggcctgggacttggcagctatatggacctcaagaaggcgcttcaggactacctgatcgtgcgcgtcaacgccggagaccggctgaagctggcggtggcgggcagcggcagtgcccaggatctgtaccagcgggtctgccgcgccgagcgggaggccctccagagcaccctggacggcaactccgtggagctgctgctggccttcacccaagccctgcgccgggccaggcgtattttcatcgccgcccatgacttcagccgttttcccgccggatacctggagcaccggctgctctcactggagctggactgctgcatcctggatctgcaggcccggcaggatatgttccggcggctctccgcccagccgccccaggatgggctgctgattgccatcaccgtgcccccgtacggcaacgacaccatcgccctgacccgctactgcgcttccatcggcatgcccgtggcagcccttacggaccggcccgattcccccgtggcccgctgcgcccagactaccctgctctgccatgtggagctgatgggtatgaccaactcctttacctccatggtcggcctggtggacaccctggctatgctctatacctttaccagtggcgctcccacccaggaggagaagacctgccgtgacacactgcaccgaaagtttgacagttgtttttccgacccaaacacttcaatatgaatttaatcctgcacaaaatcccctctttttatggaaagaggggatttttctatcaatttgcctggcgatccgtcgcgaaaaacagttgcaattgacaaaagcatttgctataatttagtttatcttactacagtaaacgctgtagtagaaaacattagtaaggaggagtatgcatgaatcctaccgcacggaaactgacggccctgtctcttgccgcggtgatgggcctgggcctggccgcctgctctggcggcagcggaaatggggacgccaccggcaccgcgtcccctacccccggcaccaccgcagagccgacatcctacgccgaccagatcgtggtcggcattaccgccgagcccaagtacattgagcccaatgcccccggtatgggccctgccgaggttcaggtgtcccagcagattttcgagggcctggtccgcaccggcgacgacggctccatcgagcccgtcctggccaccgactggaccatcagcgacgacggcctgacctataccttcaatctggtgcagggcgtcaagttctccaacggcgaggatgtggagcccagcgactgggtctggtccttctaccgcgcccgcgactacgaaacctccaactaccgctatatcgccgaggccatcgacaccgtggaggccaccgacgagcaggtggtcatcaccctcaccgaacccaacgccgcctttctggccgagctgggctgcttcaacatggtgctgggcgaccagtcctatgccgagagcatgagcgacgaggagtacctgaagaacccggtcggcaccggcccctacatgctgaaggactggacccagggcagcagcctgactctggaggccaacccctactaccgcgtggagggcatgcccaagaccaaggagatcaagtacgtcctgatcgccgacgacaacacccgcctgatgcagctccagtccggccagatcgacgtggcccccaccttccccttctctctcgcccagggcgtggagagcaacgaggccctggcgctggacatcttcccctccacccagatctactatctgaccgtcaacaccacgaagcctccctttgacgatgtcaaggtgcgccaggccctgtattacgcgctgaacaagtccgagctggccagcgccatcgccggcgagtacggcacccctgtggccgccattgtctccgagacccagggcgactggtgcaacaccgatctgcaggtgaccgagtacgctcccgacaccgccaagcagatgctggccgatgccggctacaccgagcccgtggagtttaccctgtccatccgcaccggctccaccttctatgagcagattgccaccctcatcaagtccgaggtggaccaggccggcttctcctgcaacatcgagcttctggagtccgccaccctgaccgacaagtacagctctcagagccaccaggccaccattctccagtgggtggacgactaccaggatccctccggcgtggtgggctggaccgtggactacgatcaggcccagtgcttctacaccggcctgaacgacgaggagctggacgccctctacatggccgcccagacggagatggaccacgataagcgcgtggagatgtaccgcgacattcagcagcaggtgtatgacaacgccaacgtcatccccctgtaccggaatgacttcgccttcgcccgctccgccaaggtagacggcctgcaggtcaaccccttctacgtgtaccaggccatgtactggaccaaggccaactgagccgcgccctcccgttcgcccggacggcggggccccagccgcggggggtggagcatacggctccatcccccggctctttttgcgggacgctctgtccatggggaaggtgcggcttccccgtggacaaggcgttccgcagttccccgggaacgggacgcgcggtcccacgaactgacagaggcaggtgtaacttcttgaatcgactcaactacatcctcaaacggatccttcagatgattccggttctgtttgtggtcaccatcctggtgttttccatcatccgcttcatccccggtgagccagcccgcctgattctgggcgagaaggccacagaggaggctgtggccgccctgacggagaagctgggcctgaatgagcccctgctcacccagtacctcctgttcttgaagcagattttcactctggacttcggcaactccttcacctaccagatgccggtgtccgagcttctggcctcccgctttccggtgaccctggcgctgaccctgatgagcacggtgatctctctggtcatcagcctgcccctgggctattttgccggcgtccacaaggaccgcctgggcgaccaggtggtgcgcaccacctccctggtggccatctccatgccctccttctgggtgggcctgctgctgatgatcgtctttgccctgaagctgaaatggctgccggccggcggctggtcggacacccttctgggacagttccgctgcctgatcctgcccgccgtcacccagtccctcatgacctccgccctgctgctgcgcaacacccgcaactcggtggtggatatcacccgcatggattatgtggactttgcccgcagcaagggcattaccagcggtgaggtacgtacccgccacgtgatgcgcaacgccatgatctccaccgtcacccttctgagtatgcgcatggcggccatgctgggcggctcagtcatcatcgagacggtgttctccgtacccggcatcggcaagctggccagcgacgccatcttcggccgggactatgcggtggtgcagtatgtggtgctgctctttgcggtgctggtgctggtcatcaatctgatcaccgatatcctctattccttcctggatccccgggtcaatctgtagaaaggggtgtacgaatgaaacgttatcacggcgtcagtccgctggagcagaagcgctccatgccggcgtggctggccaagccctctttcgtgatcggcctgctgattgtgctggtggtcatcctcatggccctgttcccccagttcatcgccccctacgatcccatcgccaccgacgtcaccgtgtccaaccaggcccccagtgcggcccactggttcggtacggacttctacggtcgcgacatcttctcccgcgtcatctggggtacccgcatcgatctgctcatcggcgtgctgggcgtggtgattccctttctggtgggcggcatgatcggactgctggccggctactacggcggcttcctggacagcctgctcatgcgcatcaccgatatcatgatggccttccccttcaccattctggtcatcaccatcatggccatcctgggccagggactgatcaacctgttcatcgccctgtggctggtggggtggatgagctacgccaagctggtgcgcagcgaggtgctggtgctcaaggactctgagttcatccaggccgcgcgggtggccggcttctccgacgcccggattctgttccgccacctgctgcccaacgtcatcagctcggcggtggtcttcgccgcctccgacgtggtcatgtgcatgctcacgggcgcgtccatgagctttctgggcctgggtgtttcaccccccacaccggagtggggctccatcctcaacgagggccgaaacttcatcaccttcgcctggtggcccaccctgttccccggcctgttcctggccgtcagcggcgtcggcttctccctgctgggggacggcctgaccgacttcctgcgcacgaaaggacggtgagcccggcatggaaaaactacttgaagtcagtgacctccacgtggccttccccagcaagcgggagaccgtccgcgccgtggacggcgtctccttccaggtcttccagggggagaccttcggcctggtgggcgagtcgggctgcggcaagagccagaccctccgctccatcctgggcctgctgaagcagcccggccggatcaccggcggcgaaatccgctacaagggggcggacatcgccaaaatgagccagcgggagctgcaaaaaatccggggcaaggagatctccatgatcttccaggagcccatgaccgccctcaatccggtgctgcgcatccgcagccagatgtacgaggcctttgagggggagaagctgtccaaggaggagaagcgccggcgggccattgaactgctcaagctggtgggcatcccctcccccgagacccgtctggatgagtatccccaccagttctccggcggcatgcgccagcgcgccatgattgccatcgccctgggcgcccggcccaagctgctgctggccgacgagcccaccaccgcgctggatgtaaccatccaggaccagatcatgaagctgctcaaccagctcaagcaggagctgggtatgagcatcatcctggtgacccatgatctgggcgtcatcgcccagatgtgcgaccgggtcgccgtcatgtatgccggccagatcgtggagatgactgacacggttacgctcttcagccgcccccgccacccctatacctacggcctgatgggctccctgcccaacgaggagaccgccggcaccacgctggaggccatcaagggttcgccccccaacctagcccacctgccggagggctgccccttctccccacggtgcaaatacgcctgcgacctctgccgcagggagcggcccgcgctcaccgaggtggagccgggccacctggcccgctgtcaccgcctggacgtgaccgcgtccttccagggcctgatcgaggtgccggacggcgccggacgaaaggaggacaccccccatggctgattcccgtcccctgctgctggaggtggaacacctgtgcaaatggtttccgctgaagcggacggccggcgatgtgctccagcggaaggaaaagcgctacctcaaggccgtcaacgacgtgtccttccagctcttcaagggggaaaacctgggtctggtgggcgagtcgggctgcggcaagtccaccctggcccgcaccattctccggctgtatgagcccaccagcggcaccatccgcctcaacggcacggacatctcccacatgaagggcgatgcgctccgcaggctccgcccccagatgcagatgatcttccaggacccctactcctccctcaacccccgtatgtcggtatatgacaccatcgccgagatgctgcgggtacacaaggtggtgccggccgaggagcttcccgcccgggtggagcagctcctcaccatgagcggactgaccatggacatcgccgagcgctttcccggcgagttctccggcggccagcgccagcgcatcggcattgcccgggccctctccctcaaccccgcctttattgtggcggacgagcctgtatccgccctggacgtatccatccaggcccagatcatcaatctgctggcccagctccagcgggagctggagctgacggtgctgttcatctcccacgatctgcgggtggtgcgccacattacccaccgggtgatggtgatgtacctgggcagcaacgtggaggtgggccccaccgaggccatcttccagcaccccgcccacccctatacccaggtgctgaccaaggcggcccccaagctggatcccctgaaccgccagcgggactacgccattgagggtgaaccccccagccccatccacacccccaccggctgcaaattccacccccgctgcccctactgcacggacaagtgccgcagcgaagtccccgagttaaaggagatcgcccccggccacctgtgcgcctgccactatccactctgaagccagcccgaccggactgcgctccgcacaatacaaggaggtaataccatgcgtttatccaacctgacctggcccaaggcagaggaatatttccgcgctcacgataccgtcctcatcggcatcggctccatcgagtgccacggccgccacatgcccctgggcaccgacaccctcatccccgacttcctgctggacaagatcgagcagaagagcgacgtgctcatctgccccaccatcccctacggcgccactgagagcctgtgcgactatcccggcaccatcaacctgggcaccgagctgctctatcaggtgctcggccgggtgtgcgacagcctgttccagcacggcgcccgccgcttcgtcatcctcaacggccacggcggcaacatcaagtccatcgaccgggtgggctatgacatccagcgcaagggcggtatcctggctgaactgaactggtggctcatggcctgggacatggacccggcctggaagggcggccacggcggcggcgaagagacggcggccatcctgggtattgccccctccctggtggatcagagcgaggtggccggccccatgaagctccacgacgtatccgataccctgaaggccaccggcttcacctccattgaatacaagggcgtcaccgtcaacattccccgcctgaccccctccgtcacccacaacggatggattggtcccgaccaccccgagaccgccaccgaggagtggggccggaagatgctccagaccaccgccgactacatcgtggacttcatggaggagttcaagaaggtggacatcgccaaggcctgcggcaccgaattttaattggttagaatgtggggatagacacgaatggataaaaagcaatcactggaactgtgcgccgccctctccaacgccaagggcgcgcccggctttgaggacgaggttctcgcggttctgcgccgctacggcgaggggctgggctccttccgggaggacagcctgcgcaacctctacctctcccgcagcgggaaccagggcggacggcccatggttcaactggacgcccacaccgacgaggtggccttcatggtgcaggccgtcaagcccaacggcaccctgcgcttcaccaccctgggcggctgggttccctccaacatccccgcccaccgggtttgggttcagacggccgccggggactatatccccggcgtcaccgccagcaagcccccccactttatgagcgaggccgagcgcaaggcccagcccgccgtagaggacatgagcatcgacatcggcgcctcctcccgggaggaggtactgcgggacttccgcgtgcgcatggccgccccggtggtgcccgacgtgaccttcgagtaccaggagaaacacgatctgatgattggcaaggcctttgactgccgcctgggctgcgcctccattctgcgcaccctggacaatctgcgggacaagacgctgaatgtggacgtgaccggcgcgttcgccgtccaggaggagatggggacccgcggcgccactgtcaccgccaacaccgtgaaacccgacctggccatcgtctttgaaggctgccccgccgacgacaccgtggccgaaccctatatgatacagaccgccatccacaaggggcccatgctgcgccacatcgacgcccgcatgatcaccaacccccgcttccagcgctatgccctggatctggcggaggagctgggcatccccgtgcaggagagcgtgcgcaccggcggctctaccaacggcgcgcccatccatctgtccaaccagggcgtgcccgtcatcgtcatcggcatccctgtgcgttacatccatacccactacggcatcgccgcccacagcgacgtggagaacgccgcccggctggccgccgccattttggagcggatggacgccgcgcagatcagccgcttctgagtcccaaagctgcgcccccatgggggcgcagcttttttgttgatcccagaaaaaccgtaccatacgctctctatacttctgctaaaatccgctgtccctcctggctatttgcagttgatctttctccttttccacacatacagccgtaaaatcgcccaatgattctccttgacattttgtctatattgtgcaaaaatgtagatacagcatttctcatattaaaatctgcacgctttcttgcagaaggggggctcatggacctgtcccaagccgcggccggctgaattcaaaaaaaggtgaggtaatcaaacatgaaaaaatcccttcgcgtcttatccgtcacactggcgggcgcgatgctcctcagcaccagcgctctggcgtgtaccggcgtgtacgtaggcaaggatgtcagcgaccaggggacctatctcattgcacgcagcgaggatcagggccagggcgactacaacaaaatgtttcaggtacagccccgggtggaaaatgtgcccggccgcttcatcaccgataccgccaccgggttccagatccccctgcccgccaccacctataagtacacctatgtccccgactacacccggggcgacgacggcatgtaccccggttcctgcaccaatgagtacggtgtgagcatcaccgccaccgtctccacctccacctgcgaggcctgggaggccgaggatccctttgtggagcccggcctgcgtgaggccattctggccgcctcggtagccgccgtctccaccaccgcccgggaggccgtggatgtgctgctgggctatgtggacgagtacggctccgaagagggcaacaccgtcatgatcaccgaccagaacgaggcctggatcgtggagatctacggcgggcaccagtactgcgccatgaagatgcccgacgacaaggtggccgtgttcggcaaccacaacatgatcgggctggtggaccccaaggccactcccgaggacggctacatctactctgacggtctgttcgacaccatcgacaagctgggcctggccgtcaaggagggcgagctgtaccacctggccaaatcggtgaccaacaacacccgcgaggactacaacaacatgcgcaactgggccggcatgaccatcctggccccctccctggcgggcgagtacgactccgatgaattctatcctctgttctactcccccgacgagaaggtcagcgttctgaccgtcatggatatctaccgcaaccggtacgagggcactcccctggacgtgaccctgcccggcaatgaggagaaccgcgtcatcggcaccgagcgctcctcccagatccatatcctccagaccttccccgactggcccgcggagtgctcctccatcgactggctggccctgggcaacacggagcactccgtgttcattcccttcttctccggcattaccgacaccgccccggcctatcatctggacggcgacacctacaaccccgacggcgccttctggaagttcaagagcatctgcaccattgctgaacagaaccgctccctgtatagccagggtgtaaaggacttctggaagctccaggaggagctgatgtaccaggagatgctggatgccgcccccgccatgctggccaagtactccgagagccgcgccgcaggcgacgcctatgtaacccagctcggcattgatatggcggagcgggagatgcttctggcggataacctgtacgccaagctgctgaccaccatgatgcacaacacaggtctgtcctccagcaagacacccaccaccttcctctccgacgttcccctgcgccaggtggccgagagccgcggctacaccgtcacctggaacaaggccgacggttccaccaccatcgccaagggcgatgtcacctatacctttacccctgagaactatgaatgtgtcaccggcactggtgaaaccattgagctgacccactactgctatgtgcgggacggcttcacctatatccccatggattttgccaaaaccctgtaaacaatcacaaaaacacaccgcccccggctacgccgggggcggtgtgttttttaatccgcctcctgcggtccaagcagcacgggctggagctggcggccctccagcgccgcgtcgatagcggctgggaccagggaaaagtcggccaccagggaggtgggcttcttggcgggatcgtcctgccggaaggggacgaaatagacgtttttcttgtccagcagtacgccgatattcctggccgaggccgccagaccgtcgttggtggcagggcagagcaccaccggccccccgttgcgcaggtgagccttggccgccatggtaaccgtggtgtccgtgacgccgtttgccagcttggccagggtgttgcccgtgcagggacagatgaccagcacatccagcagatgcctgggcccaatgggctcggccttggcgatgctgtccaccaccctccggccgcagatgcgctccatctcccgcataaagtcgtgggccgccccgaagcgggtatcagtggcggcgccggcctccgagacgatggggagtacgtcgccgtacctggactgtacccgctccagcacctccatggcctggctgtacgtacagaaggagccgcagaaggcgaatccaatcttcctatgttccatgttcacactcctaattcggtgaggatgttatagatggttgtcttgatgctcttgcccgctgtgaccggtgccaccttgccgggcagagacagggcccagaaggccttgacccccagccgggccgccgcgtcgaagtctacccctccaggcttggaggccaggtcaatgaccaggcagcccggcttcagatctgccagctccgcctcccgcagaacgcggacagggacggtattgaccaccagatcatagccgcacagccagccctccaactgcccggtgtgctccacgccgtagccgcagttctctgcccaggccaggtcggcataccggcgggccgccacgctgaccctggccttcaggcccgccagccggtcggccagcacccggcccagacggccgtagccgatcaccagaacccgggcgccgtggagggtaatgggcagctcctccatagccagctggatggccccctctgcggtgggcaccgcctttccgaaaggacaccgctgttcagcgcgggaggggggtacactcggtcacctcaacccgccgcgccgccccccgcccgccggcctgcgcccggacacggaagcacaggggcagctcctccagctcaaccagcagggcgtcggcctggaccgtgacccgctttaccgccgcgtccagcaccgcctcgcccccggccagctctcccgccagccagtccagcagggcggcgcggcgctccggccgttccgcccccgccatttccaggtcggccagccgccgggccagccgggaccgctccgcctcgctccgggcagtgagcgccgccagctcttcccggctgagggtcccgtccagaaaggcgtccagtgccctagcccggcgggcctcctgacggcggagggcctgccgcagagccgccgccccgcactccgcccccgccggccgggccgacgccagtacctccgcagccatcgcccccagaggcagtcccacctcgcccagcacgtggcggacacaggcggtcagcacgtctcccggtaccgccctcatggcgcatcccgttccccgtccccggcaaacgaagcgcaggtactcccgcccatcgggacgccgggtgcgcttggcggtgaggcgcccgccgcacgccccacacaccagcttgccggaataccagtagcgggcggaaaagcggctcctctcccccgccaaccccgcgcgccgggccagctcggcctggacggcggcaaactgggcccggctgacaatggccgggtggtggttttccaggcggaactgctcctccgccccgcggttgaccaccttccggtgggtcagatggtccacggtgcggtacttcttctggagcaggtcaccgcaatacttctcgttgtggagcagccgcagtatcatggcgggcgaccacgccccgtccgcccggaggggcggggccacccccgcctcggtgagctcccgggcaatggtgtgggcccctttaccctcctccagacacttgcggtacacctcccgcaccacctccgcctgctccggccggatggtgagcgccccgccccgcagcgcatagccgtacaccgtgtcgttgccgaaggccaccccccgccgcatggcctggagctgcccccagcgggtgcgctcggagatcttacggctctcctcctgggccacgctggccatgatggtgaggcggaactccccgtcgttgtcccgggtgtcaatgccgtcgctgaggaaaattacccccaccccctgttccctcagccgccgggtcacctggagggcgtccaccgtgttgcgggcgaagcgggacacctccttggtgagaatcagatccaccgcccccgaccgggccagccggagcagctcggcgaatctgggccggcggagggtggtgcccgacaggccctcgtcggcgaaaatgcccgcgcagcgccagccgtgccgggcgatgtacccctcaaagtaggcctgctgggccgccagggagtgaagctgatcctccttgtccgtggatacccggcagtaggccgccacccgcagcgcatgttccatccttccatgccccctttccacctactctatgcgcgggttttcccccgtctgcctgaaatgtgtggaaaacaaagcggcggcaggagcgtccgctcatgccgccgctggggccaggaaattcagttagtcaatgcccagggcggcgcgcacccggccgccgtcgaaggcggggatgcccagcatccggcgggcctcgtcgggggtggcgggggtattgccgaaggccttgacggcgttgacggcccgctccaccagcatgtggttggtggccatgaccttctcgccgttctccttcacctcatacaccacgttgtcctccatgcccacgcggatgtggccgcccagggccagggaggcgaacaggatgggcaggtggcccttgcccacgccgaaggccgaccaggtggaaccggcggggatgtgctgcaccaggtagagcaggttctccaccgtggcgggcatgccgcccagcacgcccaggcagaactggtagtggcagggggtgggcagatggcccttcttcacgaagtagttggccacgcccagcatgccggcgtcaaagatctccagctccggtttgatgcccttctccatgtaaagatcgcccagcttctcgaggaactggggggagttgacgaacacgccgccgggcatccagttgaaggagcccgcgtcgtaggagcccatctcgatgccggacagctccctgtggtgggccatgcgctcgtcgtcggtggcggggtgctccggggaggcgccggaggaggtgcagttgatgatcacgtcgcagtccttgtggctgcggatgaggcggatggtctcgcggaacttctccttgtccatggcgcccaggccgtcgtcggcccgcatatgcaggtgcactacggcggcgcccagcttccaggcgtcgtaggcctcgtcggcgatctgctggggcgtctcggggatcttgtagcccgcgggggtgaccgcgccggtcagcgcggcggtgatgatggtctttgccatagctgtgacactcctttataagcaatgcacaggaagaagggacgtaccggccgccccttcttccgcgcttgtaaaattaaaactcgtagtcctccggctcgttgctgtgctcgaagacataggggttctcgatctccccggcctccaccttcttccaccactcggcggccttgaggggcatggtgcgccaggattcggcggtctggggctcctccatgtcgcgggtggcgtagcgccagtcgttgacgcggctgatgtacttctcgtcctgctgggcggagtgctcgtcgcccagatccccggcggcgatgcgcagcagggagccgtactgctcgctgacggtgtgcagcttcagatcctccaccagcagcttcttcagcggccgcttggccaggttggacatgatggtgcggttctcgtagggcatggtcttccacatgcgggcgatctcccaggcccgctccagcaccttgcccttgggcagcacctcgttgaccatgccccactccagcatctgccgggcggtgaactggcgggaggtcatcatgtagtagttgccccgcttggtgccgaagtagtgctggcacatcaggcccataccgtcgccgggcaccagccccccctgagcgtggggcacctccatcttggtgtcctcggagcacagggtaatgtcgcacagcatggcggaatcccagtggaagccggggccggggatggcgccgatggtgggcacatccaggtcaaacaccatgttcttgatgaggttggtgtcatcgaaatactggtgctggaaccgctgggtgggcagctcggagtaggtctcccagccgttggcgtcggactcgatcatccagttgtcgccgatgtgggtgtagatgatgatctcgtttttaaagtccaggctcagccagcgggtgagctggctcatggcccggtgggacatgccgctgtggtgcatggggccgtccagggtcttccaggtcacctgcacgatgccgtcttcccgcttgaggtcggcgaagtccctgaaccactccttgtactcgtcaaactcgggcagcttgacgtaatccgccattggttttcccatggtaactacctcctgattccatacagtgccttactcgccatcggggcggtagggcttcacggggcgggtggggtcgcaggggttgaccgcctcgccggcctccaccttcttgaaccactcgatgggctcggtgcggaaggcggcccagctctcacgggtgggtgcctgctgcatgtgggggaaggtgtagcgccagtcgttggtctggctgatgtacttctcatcctgctgtgcggcattgcggtcgcccatgtcaccggcggcgatgcgcagcagggagccgtactgctcggagacggtgtgcagcttcagatcctccaccagcagcttcttcagcggccgcttggccaggttggacatgatggtgcggttctcatagggcatcgtcttccacatgcgggcgatctcccaggcgcgggccatgacctgatccttgggtaccacctcgctgaccatgccccagtccagcatctgctgggcggtccactggcgggcggtcatcatgtagtagttgccccgcttggtgccgaagtagtgctgggccatcaggcccatgccgtcgccgggcaccaggccgccgtgggcgtggggcacctccatccaggtatcctcggagcagatggtgatgtcgctgagcatggcggagtcccagtggaagccggagccggggatggcgccgatggtgggcacgtccaggtcgaacaccatgttcttgatgaggttggtgtcgtcaaaatactggtgctggaaccgctgggtgggcagctcggagtaagtctcccagccgttggggtcggactcggtcatccagtggtcgccgatgtgggtgaagatgatgatctcgttcttgtagtccaggctcagcacgcggaccagttggctgatggcgcggtgggacatgccgctgtggtgcatgggaccgtccagggtcttccaggttacctgaaggatgccgtcctcccggtacagatccgcgaagtccttgaaccactccttgtactcctccagctcggggagcttgacataatcggccataggttttcccataatgcatacctccaaatttcatttgatatacggattggattgatttttcactttcagaagagcacgactgccataagcacagccagcagccccgccagcaggttgaccagcacgctcatcatgaactgctggaagtagccgtccttataggagagcttgaacacggatagctggaaggcaatggccccgttgtggggcagggagtcaaagcccgcgccggagatggcggcgatgcggtgcagagctcccacattgatggcggggttgccaagaatcgtggcgccgaaattctccataaacagggtcacgccgccggtgccgttggccgtcataccggccagcaggttgaccgccacaaaggtgagcaggtaggggttcatatccagggagagcacctgctccaccagccagccgaacaccggggtggcctgcacggcggtgccgtagcccaccacgatggaaataaagacgacagggatcagagagccctgaatgccgcgcacgcaggtctggaagggatgggccagccccttgcggcccaccagcaggaaaagcagggcgatggagagcacctgagcgtaggtcgtggcctggatggcggtgatgccgaaccactggaacagcaggctcaggccgatgatggccgccacgcagaggtatcccttccaggcggggggcagggatgcctcgtccttatcgtttttagggtcgtcctcgtaggtcacaaagccctcccccctggccttcaggcgcttgctcaggagaatcaggtagcccacgatgaacgccacggaaaaggcggtacacaccaggctgatgacgggaccggccatggtggtggtgcccaggtaggtggttggggcgatgttcagggcgtttggcatgccaatgagggtaccgtaggccacagagccggcgccggcggacatggccgccagggccaccttccgggacatattcagctttttcagtacgggcagggagatggccaggacagcgtactggtaggaggccacgccggcggccatcatcaggcaggtgatgacgaatagggccacggcgatccacttctcaccgaagattttgatcatgtgggtggccatggcatcgcccaggccactctccatcagacagaagccgaacgcgccgccgatggtgtagagcaggaagaactgctgaaacatgttgcccatggagggcaggaacgtggtgaagatggaggtcaggccgtccggggtgcacaggcacaccagcacagtgcaggcaaagacggtcagaaacaggttgacgccacggaaactgagaaagaaaaacagcacgaaagcaatgatgaccaccatcaaggaaactagtacgctagctgacattaaaatcttctcctctctatttatttactttttccgtgccctcttctttttcacctcctcacaaacgggcagaataaggccgtctactctgtctggaaaatgcctgccgcgcccatgccgccggcgatacacatggtaaccatagcatacttgccgccggtgcggcgcagctccgagatggccttgcagctcagcaccgcgccggtagcacccagggggtggcccagggccatggcgccgccgttggggttgaccctggcgggatccatgcccagctccctgatgcaggggctgacctgggcggcaaaggcctcgttgagctcaatcacgtccatgtcgtccatggtcaggccggtgtactccagcaccttgggcgcggcgtagatggggcccaggcccatgtaggccggatccaggccgcccacacagaagcccaggaaagaggccaggggccggatgcccatctcggcggccttgtcccggctcatcagcaccaggaaagccgcgccgtcgctggtctgggaggaggtggcggcggtgacccggccgttctcccggaagcagggcttcatggacgccatcttttccagggtggtgtcacggcggataccctggtccttgtcaaagacgatctcgttgccctcggcgtccacgccgggcagggggatgatctgctcgtcaaaataccccgcgtcctgggcggcggccgcctttcggtggctctccagagccaggcggtccatctcctcccgggtgacgttgtacttctccgccacgttctcggcggtctcgccgttggagatgtactgggcggggtcgtgctccagcagccaggggtccatgtcgccgctgcggtccagggtcatgggcagggcggtcatggactcgatacctccggccacgatgcagtcggcctgtccggcctcgatctgccaggcggccagggccacggcctggagagaggatgaacagaagcggtccacggtaaggccgcaggcggtgtagggcaggccggcccgggcggccaccagccgggcggggttgaggccctgcttggcctccgggatggcgcagcccagaatcacatcctccaccagggcggggtccaacttggggattttctccatcacgcccttgagcaccagcccgcccatgtcgatggggtgcagattgcgcagggcgcccttcttgccagacttggccacggcggagcggccataggccaccacgaccgtcttgctcagcggttttgccatatcaatcttcctccatttccttcaagtcgggggacaccaggagcacgggctccaccgcggcctggatctcctccacggtgtggcccttccggatctcggagaggaccagcccctcctccgtcacgtcgatgacgcagcggtcggtgacgatgtggttgacgcactttacagcggtgaggggcagggtacaccggctgaccaccttaggggagccgtccttggccaccagctccatggccacaatgaccttccgggcgccgttgcacagatccatggcgccccccatgccgaaggcccggccgggggtggcccagttagccagatccccctgtgccgacacctggagtccgcccagcaccgtggcggcgagacgtccgcagcggatgacgttgaaggacatggccacatcgaaggcgctgctccccggcacggggacgaagggcactccgcccgcattgacgaagcgctcgtttttcatcagtccctcctgcaccgtggggccgatgccgatgaagccgttctcgctctggaagagtacgccgtccacggcgtagctgccgcagaggcttgggatgccgatgcccaggttgaccacgtcgccgggccggaaataggcggccgcccgcttggcgataaagtttctgttgtccattgtcccgcctccttacgccagaatcatgtccacgaacatgccgggcaccttgatcttgtcggggccgagctcccccaggtcgcagaagtggtcgcactccacgatggacagcgcgccacaggtggcgatcaccgggtgggaggcgtggccgctgctgccgctgtaggccaggttgcccagggggtcggcccggcggcagcgggtgagggcgatgtcggcgcggagggcggtctccagcagatagctctcgccattgacctcaatgatctgtttgccctcctccaccacggtgcccaggccggttttggtgagcacgccgcccagccccgcgccgccgcagcggatgcgctcgatgaaggtgcccatggggttgaattccgccttcagcgccccggactggattttggcgttggtcagggggttggtgcccacgtgggtggtgatcatggcgtccacccggccggcctccaccagcaggctgacgccgtggcccgggtcgctggagtcgatggagtagatggtcagatgcctggcgccgctctccagcacgcagtcgatcaggcggtcgggcatgtactggttggtctgtccgccgatggcgatgatctgcccatccttgaaccgggcgatgatctcctcggccgttctcactttactcagtttcatatcattctcctttgcaggacggggctttcaggaagcgggagagcgccaggccgatgacggccagcgccgcggcggtcacataggcgccggtgtagctgccgcctcccgcggtcttgaaggtggtggccaggctggggccgatgaggctggccaggccgaacaccacgtacatgacgccgtagttctccgtaatgtagcgggggccgaacatgcgggcggtgaggggggtgaggagggaggccagtccgccgtagcaggaggcggccacccccatgaagaggagcaccagcccctccgtccccgtcacggccagggcggccatggacaggatgcacagcaggaacaccgccccggcggtgttaaccaggcccagccggtcggagaggctgccccacacgaagcggccggccatgttgcaggcggagaacacgctgacgaagagggcggcccgggcgggggcgtagcccagggtctgctggaggatgggggatgcctggctgatgacgatcaccccggccaccaggccgcaggtaaataccgccaccatccggtagaaggccccggtgcgcaccatctgtccccggttcaggtcggcgccgctcccctgcccgccgctggcggcgggggccatggcggcgtggaatccctccggcggctcggccagcagcagggagcccagcagaatcaccgcggcgaagagcacccccagcacccggaaggcgctgcccaggcccaccttctccatcagcgcggcggcggtgggggcccacaggatggcgccggagccgtaggcagcggtgcccaggccggaggccatgccggagcggtcgggaaagaggcgcaccacataggccatcatgctgggatagatgaagcccacccccaggccggaaatcacgccgtagaacaggtagagctgccagagctggcttatcaggccggcggcgaagaggccggcgccaaagaggacggcccccacggccacgcaaaggcggctggacatgcggcggattagcccgccgaagaggaggggggccatggtggagcacaccaccgtgatggtgtaggccagggccaccccggagtcggcccagccaaaccgggcgatgatgggggtctggagcacgctccaggcgtagccgaagccggcgcacacgcagatcaccatggcggaaatcaggcacagccagcggcggtcggcgaaggcccggacggatgcggtcgtattggcggtcacccggtttcctcctttacagcttcttgtggagcttgagcagctcaatgagcatctggtcgcggtaggccgcgcacgcctcgttggtgtggccgatgtggtcggggaagtgcttcatctcctcatccacgccgggctgggccacctcggcccagttgtcgggctggtgggtccaggaggccatgtcggccagccagcggtcgccggagttgcccagcatattcaccatgccggtcaggccgccggggttgcccagctgcatgatcatgttgtggccgaagatggcccagcgcaggccggggccgtagaccagggccttgtccgcgtcctccacggagcacaccccccgcatcaccagatcctgtacctcccggtagagggccagctggagccggttggcgatgaagccggggcactcccggcgcaggaggacggcctccttgccgatggactggtagaagtcgtaggccagccggagcagggcggggtcggtcttgtcgccagaggtcagctccaccagggggatgaggtggggcggattgtaggggtgggcccccacgcagcgctccgggtgggccgccttggcggcaatgtcggagatgagcaggccggaggtggagctggcgtagagggcgtccgccgcggcgcaggcttccacctgggccagaatggactgcttgatctccaggcgctccgggccgctctcctggatgaactgggcgtccgccacggcctcctccatggaggtggtcaggcggatggccgccacgatctccccccggcgctccggggtaatggcgttaaattgctccagagcgtccaggctcttgtgcatctgggcctcgctccttttgagctgttcgtcgttgatgtcgtacagggtcacggccagcccgcgcatggcgaactggatggcccagctggagccgatcacgccgccgcccacgcaggcggcgcgcttgatatctgcaaccttcataatgacatatctccttattgccggggtggcaggtgtcccggcggggcgttgctccgccccagccgggatatggcgagccgccaggcgttgtggggacaagcgtctggcggcctcgttctggttcagcattccgaagggtcgtccggtagaggcccggaggggtctcgcaggctgtgctgaaaagccgcggacaggcgttatctgcggtagcgcaggccggtggcggagcgcaccatctcgtcccaggtggcgaagtcggtgctctctttcacaaaggcgtccagcagcggcggggcgtagatcagggtatccgccttccagttgaccatcacggcgctggaataccggaagccctcaaagctctcaaagcgggtatactcctgcatgaagtcgtcggtgaagatgtcctccagcaggcgcatcagctctggggcgttttccagaaagacaaagcccttacttatcgtctgatccatagaacttctccgcctctttttccacgtaggagcgccaagcgggggcgtcgatctccatccgctcgcggatccagtgcatctgctcgggcttgccggtcatggcctccttgcgcagcacggacatgtagagggagccctctccaggggggcacccctggaggaagaaggcgttgggatgctccttcaggtgcttgcgggcgcagttgccgtggagcaggatcttctcgtccggggtatcgggggaaagggtgttccggccgccggccaccaccaccatgtcggtgttgtcatcatagacgccgatggccttcagcgtctccatgttgagggtcagcagggcctgacagctggagcaggcgccctcacagtggacctcatactcgggccagcggttgcggatgtcctccaggtaggggacccacatcttcttgtagcagtcggccaccttgtcgcccaccacctcgatgtcgtcgcggttggtggtgcccaggccggcctcctgggccacgcggaagtagtccacgccgtcgggatcaatgcccaccagctcgcaggcgatgcggtccagcgccacggggtcataggagcccatgatgcagtccacctcgatgggcacgggggtgtggggggagtagccgctggcggcgtgcatcacgtccatgatgttgatgtcggcgcggcaggcccaccacacgtccatcatggccatggtcaggttctgctggtgcatctgaacatggacctgatcctgcaccacgcccttgatgttcttcagcgcgccggagaacaccatgctggcgtgggccttgaggatgggcaggttgatgatgtgctcggcctccagcagcaggcggggcagcttgacgtggctgatgttggagcggtagccccgcacggctacattgatgagatccttgtccttcttgatgtccaccagctcgacgccctcctcccgggcgacggcggcgatgccgcaggcctcatagcactcgtcggtgtcgcagcccacggcggcggcctcggcgatgacaatgcgcttggggttggccttttttacctcacggatgacggcgcggacggtctcggggtgggtgcacacggcgaactccgggggagccgcgtgccccgcgttgggcttgagcacaacggtggagttgggctcaatcattttggcagcgccgcccatcatgtcaaagacgcgggtgacattctcctgcacgtccaggccatgagccagcgccacaagggacttcttgctcattgcgtttacctccttctaaagattgcctatttatgggcccggccgcttactgcttgtgcgcggccatgtaatcctggtcatacttgtgatcctgcagggcgagaatcagcagaatcgaaaggaacgccagcccggcaaacacgatgtaagccacgctcaggctgttgaacagcttcttgatgaggccgttgacggcgaagttgcacatgaagatgatgttggtcagggggaacaccacgctgttgaccttggcgtagcccacccgaccgaacacagagccggggacggagttcatcagggcgggggctgcggcgcccaggaagccgataaccaccagggacacccacaccagaggcatcacgccgctgatgttgaagagcatggccacaatatacagcacgccggtgagcacgccggccttcttgatgcccagcctgaacaggatgcggccgaagatgacggcgccaataattccgatgacggcgatagcgctcataacactgaccgccagatcgggggcaatgcccacctcaatgttgcgggccaccagctgggtcatgatgcccatctgggccagcatcagaaagccggtggacagagcgcacagccaggtctccttggtgcgcagcagcttgccggtggtccagccggagttgtccagctcggggggcgcggaggagtagttggccttgaactcggcctcggtgacgttatcgggatagaggccccgctccttgggggtatcgcgcagaagcgccatgccgatcacacccaccacggcggccacgccgccgcagatcacagagcccatcggcatgccgatcgagcccgccaggacgttgagcagcgggacaaagagcatggttccaaagttggagcccattgccacgatgctcatggcctgtccctgtctcttggggaaccacatggccaccagagtacccacgcccacaaaggagccggagctgaggccgccgcccacaaagcacatggcgattaagtacatggggacattgacggcgttgcaggccgcgatatggcccaagcccgccagaatgaggcagccggcggccactttgctggggccgatgcgctggttcacctgccctgctgcgacggcgatcagcacgccgacgatgccggccacggagttcatggtcaggatgatgctttgatccacgttcagccgttccgccacagcgggagaaatgatgttggttccgtctgcaaagaagccgccattgctgaaaaacaccagcagtccaaagatcagcaataaccagccccagggtccaaatcctcttttttctctcataatacgcaatcctcctgagtggggagcggatgcccgcccgtcatttcatgaattgagtgcgccgcgccgtatagtcctgaaccgcccctttccgcgttctctcctttttgtgatttttttaacgcaggcccagtatatcctttacagccgcgtttgaaaaatatataatctttagaacggtataagcaatttatatacttaccgggagggaagttggcatggaactttcacagttgagatacttcatcgccgtagccaagctgggcaatatgtccaaggccgccgagaccttgttcgtctcccagcccaatctgagcaccagcatctcccggttggaggaggaggtgggcgtccccctctttgagcggcggcggggcaagatcgccctcaatcagaacggcgagctgctgctgaaaagcgtggagcaggccgtttcactcctggacgccggcgtccaggctgtgcggaaccagcacagcggacggcccgagcccctctccatcgtctgcatgacggacgacaccaccctcctggagcattttctgctggagcaccccgaggtcaacctgatccaccagcgggccgacctgcccaacgtcaccagtctgctggaccggtgcgaggtggatctggccatgacggtgctcccgcccccgtcggaagaggtggtctatgagcgcatctatgcgtgcaacttcggcatgctcatgcgccgggagcatccactggccgccctgcctgcggtagcccaccgggagctggcaggggtacacctggccatcgacggctcccgggtcaacaaggagaccttctgcgccgcggagaacagcaagttcggcctgactcccatcatcgactacgacgtacggcacctggaccttctcacctccctggtggagtccaacaactgtgtctccattgtccccgccgtcaagtacaaggagctctctcttcagggcaaacaccccgacctggtgttccgggagtatgccgacggcgcgcccaccgcctactggggcatcgcctataacaagcgccgtcccctgacggagctgggccagtgcttccgcgcctttgtccagagctacttcacctccatcgacacccgctacgctgatgcccaggagccttccgccggctaacagttcagccccgcccccggcatggccaggggcggggctgtgtgttcccggcgggcggaatagtgtcctaccggcaaggcggtgggcaccgcattggccaccgccagctcctcccgggcaaagtagtcgtggagtgtgagtccccggtccgccgccagcgccgccgtctgggggcccaccataccggcgcagatcacctgccccggccgcaaagcgtccagcaccagggccagggggtgcttccgcccggacaggggcgcgttgagcaggctgccctcccccgccgccggcagggggagcaccacacagtccgccagggcggccccctccaggctctcctccatctccaccccgtccagcgcgcccagccgctccagcgcataggcgtgcaccgtgtgcccgtctgcggccagcagctcggccagcttggcctgcctcatatcgccccccgccacccacaaattcagttcattccgcatggaatgcgcctcccttcaacgtgactactcccatcgtattcccgcgccggaaaagggtgcgtccgccccgggcggacatttcccttgaaaaaagacgaattctgcggtatagtagatcggattctgttggaatgaggaggaatggatttatgacggaaaagaggcaccagtgggcctccaacctgggcttcatcctggccgcagccggctctgcggtgggcctgggcaacatctggaaatttcccggcaaggtgggcgcctacggcggcggcgccttcctgctgtgttatctgctgatcgtgttcctggtgggctttccggtcatgctggcggagctgtccatcggccgggccacccagaagaatgtggtgggggccttccgcactctgaacccccggtggcggttcgcgggatacatcggcatcgtcaccctgtttgtcatcctgtcctactactgtgtggtggggggctgggtgctcaagtatgtccagatctacgccgccggcgcccacttcggcgccgggccgggcgcctatgccgactacttctccaccttcagtgcccgtccggtggagcccctgctgtggggcctgggctttctggtgctgtgcatcgtggtggtggtgcggggcgtgtcccagggcattgagaaggtgagcaaggtgctcatgcccctgcttttcctgctgctggcgggcctggtggtctactcagtcacccgccccggcgcgggggagggcctgcgcttcctgttcggaatcgaccccgccaggctcagcggcgacaccctggtgggcgcattgggacaggcctttttttccctgtccgtgggcatgggcatcatggtgacctacggctcctacgtgcccaagtcggagaacctggccaaaagcgccggttggatctgcgcgctggacaccctggtagccgtcatggccgccctggccatcgtcccggtggtgatgatcacccagggagaggagggactgggcatgggcggcggcttcgccttcatcagcctgcctgccatgtttgccgagctgcccggcggccgctttttcggcatggccttcttcgccctgctcttcctggccgccctcaccagcgccatcagcatcctggagagcctggtggcctttctcaccgaggaattccacctctcccgggccagggcggccatcggcctgtcggtgcccatggcgctgctcagcgcgggctactccctctcccagtccgccgggcggggcatcaacctgccctggttcgacttcaaaaacgggatgcagatgctccccatgaacgcggtgatggagaagttcaccgacaatctgatgatccctctgggggcgctgtgcttctgcctctttgtgggctgggtgtggggcaccaaagccgccgggcaggagatcgccggcgagcacggcctccggcggatgcagaagccctgggccttcgcggtgcgctttctcgcccctctggtcatcgtggtcatcctgtacttcaccctcggcatgggcgagggcctctcctgacaaaaaaagcgcggaccgttgtacggtccgcgcttttttgcgggaatactagctcacagggtgtccgcccggtaggccagggtgcggctctcgccgggggccaggacgatgcagtgggctttatcggtgaattccggcccctccgccgtcccggcggcgcagccgtgccacggctcaatgcacaggtagggggccttcttccccggcatggtccagaaggccagcatggggaagccgtcgaaggacacccgcacccctctgccgcttttgcggctgcgcagggtgacggagcgggagcgcaggccctcgaagatcagggtatccagcgcgtcaaaccagcggtagtccaggggcagggtgtcggtgtcctccaggcagggcagggccgccggccggtccagcaatccgtcccgcagcagcagggtgggacagctctcccgctcggggaacaccagctcgtagtcctcgaaccgctcccccgcctccaggggacagcggaagccggtgtgggcccccaggcagaagggcaacggcccctcccccgggttggccaccgtcaccgccgtggaaaagcccgtgtcggtcagccgctgctccaccgccagccggaaggaatagggatacagcgccagggtctcggcgctctcccgcagctccaggcgcacccagtcctccccccgcgccgccggggtgaactcccgccgccgggcaaagccgtggcgctccatggcgtattccctgccgtcaaagcggatctttccctccttcagcatccccacaatgggaaacagcaggggattgcgccccggccagtaggccggatcgcccccccagatgtactccagcccccgctcgtcccggtaggataccagctcgccgcccagggtctctacccgggcggtgcggccgccccgcttcagctccagttccatggtctccgcctcctttgtgtattgtctgcattataccgccccaattctccatttgcaaggtggaatggtttgacagatcgcccattccgggctacaatagaatcgatcgaaaaacaggaaggagcagcccactatgctgtttgcaccatacgaacgctatcagtacgcccgcgccccgctggtggaagtgatctgccagctccgcttccccactatcctgtccatcggcaccaaggagcccgccgagtttcaggaggccatccgcaaggacttcccccagtatgcggcccgtcaggagcagctcccccccaaggtggtcaagaaggggaacgccaccgcgctggagcctcagaagcccattaccaactacaacttcatctcggaggacggccgctggaagctcaacctgacccagggcttcatcgccctgtccaccctgagctacacccggtgggaggacttcgccacccggctggaccgccccctggcccagtttatccagctctaccagcccgccttcttcgagcgcatcggcctgcggtatgtcaacgccgtctcccgccagcgtttgggcctggagggggaactctgggacgatctgatccgcagccagtatatcggcatactcggcgagcctgacgtggaggagagcgagatcgccaagtgttccctggacgtggagactcccctggtgggggactaccggatgaagctccacgccggtcccggcctcatcggcggcggcaagaccgacaaggaggtcaagttcattctggacggcgacttctccaccgcgggcaagcacaaccccgacgcggtgcccgaaaagctggagcggatgcaccggttcgccgtctgcctgttccagggcgccatcaccaaggagcttcacgaggccatggggcccacccctctggccgagtaaatcacaccgcccgccggttccccggcgggcggcctgatatcccggcgcggcaagactgctcttgcattttggtaaaaaactgcttataatacaggtgtcttgacagaaaggtggtggacgcggtgaagcggttgcttctcgtagtggactatcaaaaggactttgtagacggagcactgggctttcccggtgcggaggcactggacgggcccatcgcggccaaaatcgccgcctgccgcgccgccggagatgacgtggccttcaccctggacacccatggcccggactacctggacacccaggaggggcggaagctgccggtgccccactgcctgctgaactcggagggctggcagctctacggccagacgggacaggccatggagcgcagccgggatatggtcatcggcaagggcgccttcccctccctgtggctggccaactggctgaaggagcagggctatgaccgggtggagctggctggactggtatcctacctttgcgtactctccaacgccatcatggtcaaggccgccctgcccgaggcggagatcgtggtggatgcctcctgcaccgccgggcccgatccggatctccacgccaagggcctggacgtgatggaggccctccagatcacggtactgaaccgataaaggttgtgaaacagatgaaggaacacatgaactacacacttctgtgtgatttttacgaattgaccatgggcaacggctactttcagacggaggggtatgccgaccagatctgctacttcgacgtgttcttccgcaatgtgcccgacggaggcggcttcgccatcgcagccgggctggagcaggtcatcgactatatcgaaaacctccgcttcaccgaggaggacatcgcctacctgcggggaaagggctgcttctgcgagggctttctggactatctgcgcaccttccgcttcacgggcgacctgtgggctgtgccggagggcactcccatcttcccccgggagcccttcctcaccgtccgcgcccccgccattgaggcccagttcatcgagaccttcctgctgctcaccctcaaccaccagtccctcatcgccaccaagaccaaccgcatcgtccgggccgccgacggccgcccggtgagcgagtttgggtcccgccgggcccagggccccgacgccgctgtgctgggtgccagggcgtcctatatcgccggctgcgccggcaccgcctgcaccctggccgacgagatgtatggttcccccgccgggggcaccatggcccactcctgggtgcagatgttccccgacgagtacaccgccttcaagacctattgccagctctatccccactcggccaccctgctggtggacacctacaacgtgctcaagtccggcgtgcccaacgccatcaaagcgttcaaggatattttgctccctcagggcattaccaactgcgccatccggctggacagcggcgacctcacctatctgtcccgcaaggcccgcaagatgctggatgcggcggggcttaccgagtgcaagatcgtggcctccaactccctggacgagtacatcatccgggatctgctgcttcagggggccaagatcgactccttcggcgtgggtgagcggctcatcacctccaagagcgagccggtgttcggcggcgtttacaagctggccgccgtggaggacaagcagggcaatatcattcccaagatcaagatcagcgccaacccggataagatcaccaacccccacttcaagaaggtgtaccgcctgttcgacaaggagagcggcaaggctttcgccgacctcatcaccctccacgacgaggcggtggacgagagccagtccctggagctctttgaccccgacgccacctggaagcgcagccgtgtcaccaacttcaccgccaaggagctgctcgctcccatcttcctggggggcaggcgggtatacgactccccccccatcgccgagatgcgggcctactgcgccggacagatcgacctgttgtgggacgaggttaagcgctttgagaacccccataactactacgtggacctgtctcagaagctctgggacatcaagcagtcccttctggagcagaagggctgaccggtctgcccactgcaaaacaataaataccgggccgcacggcgtgcggcccggtattttgtttgctttctcactcggccaagatcagcttggccacttccagaagcatcttcctctgtcgtccgtccatctgatccaccagttgtgccagctctccctccaggtagcgcccctggagcaccgacaccccggttaccagctcggaaagttcacagttgaggtgcgccgccaccgcagccagcgtgtccagattgattttggtcacgccgcgctctatctggctgatatagcccactgacacggagagggcctctgccagacgctcctgcgtcatgtcgcggctcctgcgcacctgcttgatgcgctgtccgattgcaccataatccacgttcatccgatcacccgtttcttagtgtatcgggaatcggctttggtatacagacattgtatgctaaagtttgagttatccttgcggtttccgtgtcgaaatctgtcgagaaaaatctttcctgcccaaatactggcttttttcaccgattcccgcaagattcagcacgaaaccggctgtttctcccatgcctccagcagcagccgggcgttatgccggtagcgctccatggcccggcagagcgccccggaggccggcagaccttccagccccaactccgccagtgcgggccggggcgggtccagcagctcctgaatttctccggccaggcggctcagaacagggtactcctcctcccccagctccccggtcagtaccaggcactccacctgctccacatgggcaaacaggttccacagggtgagcagcaccgtccggtaccgctccgcctctcccgccggcagggccgccgcatactgggccgcctcgtggtacaccagatgaaagcaggccagaatctcgccggagcgctccggccggccgggcgcgtggaggctgcgctgcaccatctcccagtaggaggcctggaggcgacacaaggtacgcaggttgtgccggaactgggtagccttccgggtgggcaccaggaaacggtttaccaccaacaccaacgccactgcaagcagcaagtagaataggcgcaattggatggcctggccctcctttaccgtgagggtggccagggcaagggcgaaggaggtggaaaagatggggtgtacccaggagcccggagtacagcaatacatcagggagatcatggccagggcaaaggcgaagacgccggtcaggccgggcagccatggatagaccagatgtaccaccaggcatccgatggcggtgcccaccggccgggtgatcatccggtgggcgctctcctcatagctgggctggagcaaaagaaaggcgtggagcgggaaccagtaggtgtgctcaaattcccacaaaaggctgacggttgtgctgatggtcatgaccacggccaggcgcagggcaaagcgcacctcaaaattgttgagactcagccgccggcggccgctggcaaatacctcccgccagggcacccggggccaccgggtccggggctctccctccgccagcagcaggagcaggcggtggagaaagctgcggtagaagatacgcagccgcccctgaggcagggcgtcctctgccagcaggatctggagccgttctgtcagcgctccccgtgcctccggcgaagcggcgttctggagctgccgcaccagccccgccagcgtaaccagcaccttcccgcaggcggggccagcctggagccgcccccaatcctcgtccgccaggaggtagctcaggcgctgaaacagcagtgcaaacaggtaataaaaccgccgttgcccatctggcaggtggaagtggctgcggcgggcatagcccagccgccggaaccgctgggccagcccctccagctccctgcgcgccccgtacgccccgccgcccccggccagttcctccagcagctccgccaggcgggtcaggccccgggtgatctcctcctccggcggggcggacggggcagacagccgggcatagaggagcagcgccccgatgagcaccagcgtacagaacagcaggcacagcatctgaaccggaaattcctccggcgtgggcggccggagctccaggaacacgaaagtcatggcgtagccgaagtagcccttcggcgcgaactggtcgctctggaaaaacaccagcgcaaagggaaccgtgaagttcaaaagcacacagagcaccacattccggctggccagataggcgagcatacccagcaggagggtgatgaacagcagcttgatgtaatatgtaccggtgttgttgcgtttccgccggatctgaaacagggtggtggtgctggacaccaccatggcgttccggctcccgaacaggagtgaaaccgtcaaaaaaagaaccgcaaaaaacagaatggtgggaaacgcggccttccaccggcttcggaactgtgccgcgaaagctctgcatattccacagaaatccactcttttccactcccttcgccttttttcccattataccccgatcccctcccgcctgcaagctgatacgcttgacggcgccccagcgttttggtaggatggatcgtggacagaaaggagtgcatgtgatgaccgagtgtatttcggagggcctgtaccggattccggtgcccctgcccggcaaccctctccgggaactgaacagctacctgctccgcgggcgggagcgcagcctgcttatcgataccggcttccgacaggaggagggccgccgcgctctgtttgccgggctggcagagctggatgtggaccccagggatgtagatgtggccctcacccatctccactccgaccactccggcctggccccggaggtcgttggggaaaccggctggatttacgtcagcgggcccgaccgggcctatctggagcagccggaggaggccaaatgggcccacaccgatgccttttatatctctgagggctttccgccggagctgttggcacaaaacagggccaaccccgcccgcgctctggcccccgtccccaccggccgctaccgcacgctggaacccggcgctgtgctggaggcgggcggccgccggctcacctgcctgcccgcgcccggtcacacccctggccagctctgcttctgggacgagtcggacggcattctctttaccggcgaccacgtgctctttgacatcagccccaatatcacgccttggaacggcatggaggacgccctgggatgctatctggacagcttgcgggccgtgcgggagctgcccgcccgcctggctctgcccggccaccgccgccccggtgcgctggccccccgggtggacgccctgctggagcaccacgcccgccgcctggacgagctgaccgccatcctccgcgcccgccccggcagcaccgcctatgaagccgccgcccacatgacctggaacatccgctccaggagctgggacgactttcccctggcccagaagtggtttgccgtgggcgagtgcatcgcccacctggaccatctgcgccggcagggacggctccagcgcgagcagcaggacggtgtgtggcatgcctgggccctttaaccgcgtccgccgggcggcagcggtacattttcctcttttttatcttctcttttattctatttctgatgttctttccaaaaccgacacagtttacttcaattttatctatctgtattattattccccttttttcgcagacccgaccagcaaaaaatggcgcacatagaaatccgccctggggcaaagctatgtctggattcaccgaatccaacaaatttgtcaccaaaggagatgcgctattatgtctagctctaacaattccaattccaaccagcccgtggttcccagcgcccgtgaggccctgaacaagttcaagatggaggccgcccaggaggttggcgtcaacctgaagcagggctacaatggcgatctgaccagccgtgaggccggttccgttggcggccagatggtcaagaagatgatccaggcgtacgagaacagcatgcagtaaccagtctgcccggatcggctgataaaaacagaagcggggcggaggaatttcctccgccccgcttctgcctgtcgaaaaagtcagcggcatcaggaaacgtttcgttgccgcctcacccatgcacggggtacacatcgttctccaccacgtcccggatttccgtaaagcggccgttttcgtcaaagcaataccacgcggtgccctcatggagctgtccctccgtgtccgcccaggcccaggaatactggagggacaggccgtcctctgaccaggccaggggaacgcaccggggatagccgacggcatctcccatctggtactccgggttcagggcggcaaaggtgaggcccgacaggccaccctctttctgatgggtcagctccgggggcagcggtccaatggggaaggaaaaggacatccctgcatcaatggtccttcctgtcgaggtgactgccacccggctgccgtcaggagaccagagaggatctgagtggacggcaccgcccggcatgccgctgctgcaactgacctgtcccagcgccacagggtgctccccgctgatgtcataaagcatgcagtcccctccccacggctggatggagagcaggcgggtgccgtccggactgtccgtacggtcgtaacccagcaccagggtgttccgaacggcctccgcctcctcccggctcacctgggacagatcgaaccacaggtcatagatgccgttgttcggatcggcctggttcatcaaatagaaggtatgcagctcctcccggccgtcggcccgctccaccagcaccttgtaagtccacagaggcacgtcggcatccggctccaagtcctcaattttacaagaaagatcctccacggtcaccgccaccgcctctgccgggaggacgggattgccgtcgtcgtcgaacatctccacaccgtaggtggtcaccagggcggcaaagtcgggcaggcgatcctcccgcattgaccacttcggatcgtagcggctgacgatcatcccccatgccggcggccgcgcctcgccgggttctgtcggatcccccagatcgacgataaagccgccggccgcgtcaaaggccgccacatactcccccacaccccgcagggcgtagttttcccggtctaagataccgttgagctggcggggctcctctgccgtccccagggaacaggcggcggccccggcggagatcaccagggcggcggcgcagaccagggccacgccctttttccgcgttccgcccgacgcgatggacagcaggcgctcctttatggccgccttgccgccccggaagtgggtggtcaggggggcgcgggcctcgatgccctcctccaccgcgtccagcatggccgccccgtagaccgcccggaaggcggcgtcccgccccgccaccgccgcctcgtcgcaggagcgctccagatcccggctggcggccgcggccatccagtgcaccagggggttgaaccagtggagggagcgggagagcagcaggagcagcttataccacagatcccggcggcgggtgtggatcagctcgtgctggagcaccccgtcggacacggtctcccggggcaggaggagcgccgggttcacaaagcccgtcaccaggggcgcgcctacggcgggacagaccagcagagccaggttcttcacccccagctccgcctttgcagcctcaaaccgcgccagcagggcggcgtcctccgccggagccccccagcggcgcacccgcaggcggaagcggacgtattttgccagatgccaagccaggaatgcccccgccccggccagccacagggcggctacggccccctccagggtgaagagcggggtatagacatcctgaatggaaccgccatccaccggcctgttttctgccgctgcctcttccgatgccgcctcctcttctgtcagggccgcatagtgatggtttccgggattgctgttaaccgtgtccacccggtagacggccctgggaaccgcctccaccgtcaccggggcctggggcaggctcaggttgaaggggatgcacaggcggagggcggccagcagccacacccagtaaaaggccccggcccgcagccgcttcttcaaaaggggccgcagggccagcagtacggccagcaccacggacatggccagggagatctccagcacgtcggcaaagcgggcggtcatacgtccccctccttccccatggcctcgtccaggaagacccgcaactcggccagctcctcccggctgacggagcggctgtcatacagggcggccaccaggccgggcaggcccctcccctccaggaagggggcgttctcaaacgccaggtactccccctcgtccaccaggggggtatagacgttctgccgcccctccttccccacggacaggaagccccgctcggtcagccgggccagcagggtctgaagggcggacagattccacggccgctccttctccagccgggtgcggatggccccggtggggacgggcggctccagccgccacacggcccgcatgacggtcagctccgcctcgggcaggcggttgagcttcttcatcccattcacctcctacaaatgtatgtcttgctcaagctgagcatacatctgtaggttttatttgtcaagacaaatgttgtttttttcctcccggacggctataatgggagaaaagacccacaaaaggagtgtttacgatgtcaaatatctggcatgatatcagccccagccgcatccagcccgaggacttcgtggcggtcattgagattcccaagggcagcaagaagaagtacgagctggataaggaaaccgggcttatcatcctggaccgggtgctccacacctccacccactaccccgccaactacggcttcattccccgcacctacggcgacgacggcgatccgctggacgtgctggtgctctgttcggaggaaatcgaccccctcaccctggtgcgctgctaccccatcggctacatctccatgctggacggcggcaagaacgacgagaagatcatcgccatccccttctccgaccccacctacaacccctaccacgacctgatggatctgcccccccacctctttgacgagatgaagcacttcttctctgtctacaaggctctggagggcaagcaggccgtggccaaggatgtgaacgaccgggccgccgccgtgcaggtcatccggcaggccatggaccactatgccgagtgctttctaggcggcccctccgccaaagtgggcctctaccccaccgagccggatcagccaaccgctcccgaggggaaagggaagtaattttaagaatatcttaatgggatgtttacccctttttcccgaaacctgtggtacactgtgtttgacaccagagaagagaggacgattccccatgaatcatcaatatgactgccttgtcatcggagccggcctggccggttccgtggcggccagggagctggccgagcggggcggcaagcgggtactggtgctggagcgccggaaccacgtgggcggcaacgcctatgattgcttcgacgaggcgggggtgctgatccaccagtacggcccccatatcttccacaccaacagcacccgcgtgtttgactatctctcccgcttcacccgctggcggccctacgagcaccaggtggtggccaatctccccgacggggacgggcggctggagtacccggtgcccttcaacctggtctccctgcgggccgcctttccgccggagaaggcccgcgccctggcggagaagttggtatccgcctatggcatggagaaaaaggtcaccattctggagctgcggcagaatcccgacccggagctgtccgccctggccgactatgtgtatggccacgtctttgtccgctacaccatgaagcagtgggggcagacgccggaggagatcgaccccaacaccaccgcccgggtgccggtctttctgtcggaggactgccgctactttcaggacgcctaccagggcatgcctctggagggctacacccccatgttccagtccctgctggaccacccggacatcacggtggagctgggggtggacgcggccagccgcctgaccctggacggcagcgccgcccttctggacgggaggcccttctccggccccatcatctataccggcgcggcggacgagctgttcggctgcaaatacggccgcctgccctaccgcaccctggacttccgctttgagacccacccggtggacttctggcagagccacggaacggtaaactataccgtggatcaggactacacccgcatcaccgagttcaagtacctgactgggcaggagctgcccggccaaaccaccatcatgaaggagtactcccgcgcctacaccggagcgaagggggagatcccctactacgccatcatcaacgccgggaacaacgccctgtacgccaaataccgggcggaggcggaccgctatccgaatttccacctgctgggccggctggcggagtacaaatactacaacatggacgccatcgccgcacgggcgctggagctgtgtgacgacctattgaagtgaggagactgcccatgtcaaagctcatcacattcgcggtgccctgctacaactccgcggcctacatggatcactgcgtgcgcaccctgctcaccggcggggacgacatcgagatcatcctggtggacgacggctccaccaaggacgacacccccgccatctgcgaccgctatcaggcggagtacccggacatcgtgcgggccatccaccaggagaacggcggccacggtgagggggtcaaccagggcctgcgccacgcccaagggatgtactataaggtggtggactccgacgactggctggacgaggcggccctgaaggccgttctggacaagctgagggcgttcgccggggcggagcagccgctggacctctttatcgccaactacgtctatgagcacgtggaggacaacacgcagaaggtgatgaagtataccaacgtgttccccgagggccgcgtgttcacctggaacgagatcggccgcttccggccctcccagtacctgctgatgcactcggtcatctaccgcaccgagatgctgcgcgcctgccggctggagctgcccaagcacaccttctatgtggacaacatctttgtctaccagcccctgccggcggtaaagagcatctactacatggatgtggatctctaccgctacttcatcggccgggccgaccagagcgtgaacgaaaaggtgatggtcacccgggtagaccagcaggtgcgggtcaccaagctgatgatcgacagccacaacctcaagcagctctaccaaacccagcgcaagctggcccggtatatgaccagctacctgtccatgatgatgaccatctcctccatcttcctcatcatcgacggctctcccgccgccctgggcaagaagaccgagctgtgggagtacctgcgcaccagcaaccccgagctgtaccacaagctcaagtaccgctccctgtccttcgtgggcaacatccccggctaccagggccgcaagctgtccgtcaagctctaccgcctggcccggaagatctacaagttcaactgagcggaaaggaaaccgccgtcacgaatccgcctgttccgtaacaacccgaaatgcaaatagcccgaaaggggcggggccgcgtcagcagccccgcccttctgttatgtctccaccggctccagcttcatgacggagacctcgtaggcggtgcgcacctcactgacgccgtggtccaccttggtgtaggcccggctctggagccgcccctcaatgcgcacgccgtcccccacctccagtgccccgcaccgccgggccaggccgccccaggcgatgcagggcaggtagtccgcccggccgtaccggcggttcaccgccagcatcaaatcgcagatgtcccggcccagcggggtgcgccgcaccaccggcggcttgcacagcacccccgccagcaggagctggttttcgtgttctccggcggcggggcgcagctccttggcgtagagggtgatcaccaggcggctgcccttgccgctcttgttgttgaaggagcgcacctccccctccacctccagctccatcccctccgtcacgggccgctgctccagcagggccctagggaccaggacattgacccggtcctccgagccggacagccgccggacggcgaggggaaaggtctcgtataccacgccgtgggtctcatgggacagcaccggctccgccgccgcggtgccccgcagcagcgcccggttctcattccagcctgtttgcatatccatccactctcctacctggtttcggtaactgtggcatgtatatgcaggcccgtccccccttatgacggcgcgtcctcccagcccaggatacgcttagccatgtcgtagatgctctgccggtagagcaccagcgtcacctccatggagggatggcgctggcagaaatcggcaatcgccgccccagccacgcggagggaggccgcccgcggcatgtggcagtcgccggagaagatcagcggcaccgccacccgccggcaactgcacagatacgccttatgcagggcgttctggtagcacccggccagcaggaaccgctcccggggctccccaccgtaccagcccggcccggccacgtgaatgatgtaccggcagggcagcccgcagcccggcgtggccaccgcctgcccgatgcggcagcggcccagcttccggcacgccctctccagcttctccgtgtcggcggcggcgaaaatcgcgtcgcagatgcccgggcagcgccgcagatccgtgccggcggcgttcacaatggcgtctgtctccatccgggtgatatcgcccaaatacaaatacatgggcatcctgactcctccttttccccattctgtccctattatactacatcaggaggccgcacaccagatagcccgccgccgaaagcccggccgcacacagggaatagggcagttgggacagggcgtggtccatattctccatcttgcagcagctggaggtgagcaccgtggcgtcggagtagaagcaggcgtggctgcccagggtggcgccggagacgatggcgcccatcaccagcagggggttggccccgatggagaaggccaggggcagcaggatcggcaccgtcacggcggtgatgccccacacgctgccggtggtgaagttgagggccgccaccaccaggaaggcgatggccgggaacaccgccgggctcaggatggacttgacggcattgatgacgaagggggcgatgccgatctcggtcatgccctcctgcatcacaaaggcaaagaagatgatggccaccgtggggatcatgttgcaaaagccgtgcatggccaggtcgcagaacctagtgagagacagcttcttccgggggatgtagagcaaaaagcacacggcgatggcggccaccagggccaggaacagctcgccccccacgatagtcaaggcgatcagcgtgccgatggggagcacaaagtcccacaggcagccggtaatggccggggagtcgtcctcgtcctccagattcagctcggcgctctccggcgagtagacctttccggtctcctccacccggcggtaggccttcttcatccgccccagcttgggcaccagccccagggagaacaggggcaccagcgccaccgccgcgatggcgtagaagatgaaggggatcacagcgcagaaggtgttgatggcgctcccgtagcccagctccgggatgcccgcctcggcgtagaacagcccggcaaagaacaccgcccaggtggagaagggcagcagggcgcacaccggcgcgccggtggagtcgatgatgtaggacagggtctcccggggcaccttctgccggtcggtgagcttgcgcatgcaggtgctcagggtcatgatattcagatagtcgtccacaaagatcagaatccccatgacccaggtcacaatcagcgtggtcctggggccccggcaaagccgacccagcagccgggagaagcccagcgtcccgtgggaggcgcccagcagggcgatcagcgcgccgaacaggccgcacaccatgaacacccactggtggctctggtcggtggccacccggaaaaaggcgtccatccagccgatggggaaggaaagtccatcgacgatgatataggtgagcagggttcccagaatcagcggctccagcgcccgtctgctcttgagcgccacggccactacgacgacgattggaagcagcgtccatatcccataatccacaataacggcacctccgtttgccccccagtatacgagcacggatgtaaaaagggtgtgcgtttgcggtgagcaccgttcagattgtgtaaaaaaagcgggcggccgatggccgcccgcccggaatcagccgccctggctctgccagtcggcggggtagacgaaataaaggaagcgggcgtgcccggtgacggagaactggatggagctgttctttgggatatagatcagctcccccggcccggcggagacggtctctccgccgatacggatgtccagccgtccgctgagcacgtagtccatctcgtcgtagcgcagggtccagggaaaggtggtgtcggtcatctccatgacgcccacccccagccgcggggactcctgtagggtgaataggtcacgggtgtagacccggtccaggggatttcccgtgtccatccggtgctcctccgtcaccgcgatgcggggcacctgcacggccttcaccccgtgggttccgccgcccaggcgctccagcagcacctgccgcaccagcgcctccaatgcggtcttatccatggcgctcctccttgtattttctggtgatcagcatggcaaccgccaccgctgtcacgccgcccaccagcttgcccacaatcatgggaaagatcatggtggaatcaaagcccgcggtaaagcccagatggtcgccgaacacaaaggcggcggacaccgcaaaggccacgttgatgatcttaccccgccggtccatatcgtggagcatctggaacatggggatgttgttggccaaggtggccaccagcccggcggccgcgatgtcgttcatgcccagcacatggcccagcttcatcagaggggtcttgaataccctggtgatgacatacaccagcggaaacgcccccgccagcaccacggcgatgtcgcccacgatggccacgccctctgagatggggttcattcccggaatgagggtgaggggggtcagcttttggatgatggccgccgccaggccgatggtgataataatcacaatgattctgccaaagacctggaagccctttaccatcccgttggggaggaaggccagccccagggcgatgagcacggcgaaaagcgcgatggggatcaggttgcgcagcaccatccccaccgggaagcccgccgccaggccgcccgcgaagctgccgatggggatggtgatgacgcccgccagcacgccggtggccagataggggcggtcctccgccttgataatgcccaggcccaccgggatggtgaacacgatggtggggcccagcatggagcctacgatcaggccgccgaactgtcccgcctcctgggtcagggccagctcctgggccaggggcgcgccccccatgtcgttggccaggagggtacccgcgaacatggccggatcggcccccagggcctggtagagaggcaccaccaccggccggagcaggttggccagcaccggggccagacagatgatgccgatcatggccagggccagggagcccatagccatgataccctcctcaaatttctcccccaggccgaaccgattgcccaggatgcggtcaaacgcacccaaggccataaagacgaccatgaggtagacaataatctcgttgatggacatagtatgtcccctttccgcggctcaggcgggcggttgggccgccagcctgagaggatgaccgccgcccacatgcggcggccttgcttttctagctctcgtccagtatgcccacaatggcggcatcaatggggagctccgcccccgccgctacccgggccgcgccgccggtggccacgaggacggtctctccctccccggcccccacgcagtcggcgcacaccagcaggcgctcacccacccgcacggtcagaaacgcctgcccggtgagggcgggggatttttttgtggcccagaccttaccggccacctgtcccagcaacacaaatacccatctcccgcaggcgccgctccagaccggcgcatttctgatagatgccaaggggggcggtacggcggtagcggcggtactccagggcgtcccgctccacccgcacccgcgccccggccagcagggcggccagcacctcggtctccgccgccgtctggggggcgcaggcggccaggcggcccatggaggccaccggcagccaggtaatgaccagcgtccgcccccgccactccagggtcatttcaaaatcacgccccggtcgcccttctgaaagccgcacgcattggcctctgtttccccacaaaaggtaaaaccttttgtggggcccccgtatccttcatctgctcgggcgcaatgaatgcgcccggcatcgccccccagggggccttctcttgcccctttggggcaattcaccttgaggttttgccttcggcaaaacacttgcgtcgcgccaaaaggcgcgtctacttctcggccatgatatctcacctgcgcttcacctgcctactttaaaatcacgccccggtcgcccttctgaaagccgcacgcattggcctcgtcgtagtcgatatgcaccaccgtggaaaactggggggatacccgcacctccacgtcctggaacaccagcgggcggctggtaaagcactggaggcgcacccgctgccggtccgccacgccgaagcgggcggcgtcctccggcgtcatgtgaatgtggcgcttggccacaatcaggccgcggctcaggcggagcacccggtccccgtggcggagggtgaggccaggggtgccctccgtatcgccggagaggcgcaccggcggggtgagccccagggccaccgcatcggtgagggagatctccacctgactctccgggcgctcagggcccagaatcaccacgttcttcaagctccccctaggcccctccagcgtcacccgctcggcgcaggcgaactgccccggctgggacaggtctttcgtccggttgagccggtagcccgcgccgaacagggtctccacatcggcccgggacaggtggacatgccgtccgctggcctccagctcgatggtcaggcgggcgaccagctcctccgccagccgctccaccgtgctcaatttacttgcgttcatagcgtcccgcctttaacttaatcatgaaaatccacatcagggaggacagccggttcagccccaaaatcatgtcgcccctggtcacgttgccgtccgcgtcgcggaaggcggcgtaggcggccagctcggtctgccgcaccacagtgcgcagcttgttgaccgccagcagggcgggtccgtcggtatagcaggccagaaagtggggctggccgaagtgcttctccggatagtgggagtactcccggagctgctccggcgtatagccgcacagctcgatggcccccaccggctcgtccagcacgtcgaagcggatatagcgccggacaaagcccagaacctcctccagctccccggccagggccccatagccctcccccgccgccgcctgctgggtcagcaggatctccgcctccagggcgtcgatccagccccggaatgcgatgcgggggtggtccttgaacaccagtacattccccttcaggtgggtcatgtgctccggcttttcattcagtgcggcaccgaacagagtgcggtatttggcgggggcggacggggccccttccccggccgcctccccctgggggtagaccacctctacccggtgctcccgcagatagtcccgcgcccccggcgtgagcatctggtcccggttgaccaccacgggcccccgtgtgccctggttggacatgcggcgcacgtcctcctcggtcagcagcgccatgggttacacgttgtccatctcgccctgggcatggggcaggatgtggtccacctcggcgtgggggcgggggatgacgtggacggagatcagctctcccaccttttccgcggcggccgcgccggcgtcggtggccgccttcaccgcgcccacgtcgccccgcaccatgacggtcaccaggccgccgcccacctgctccttgcccaccagctgcacgttggcggctttcaccatggcgtcggccgcctcaatggcgcccaccagtccctttgtctccaccatacccagtgcgtttgtattggccatattacggttcctcctgtcagtcgtctgtttgggttgttccggttccgcctccgccttcggtgggggagacggctttggtttcttcgttttggccgcccgggcggccttcctggccggggtgggcgggtgctccgccgcgtagctgccggtgcccgcccccttgtgggccggggcggccagggccgccgacacgggtgtgtgcggaacgccgcccaccgccccggcgggctcgccgttgccggcgtagacggtgtgggccttatcgtcctccatcccctctggctcctctgccgtcagggagttagtcagggcctgcacctcctgcaatagcgcctcatgtggattgaggagcacgccgtcggcgttgacctcgctcatacgctcagcctccctataatccggttgaccagctcgttgagcaggctctcatccacggcacagggggcatacccggccgcggggcggttcccccgcagctcctccagctctttgacgccccaggccacccgcttgatgttgatgagatccaggggcccgatgttgttggagctggacgagccgcccaccgcgccgcaccccagggtaagggcggggaacaggcaggtggtggccccgatgccgcccagggcggcgggggtgttgaccagcacgcggctggcggggacggcggcggcaaagcgcttggcggtgtcggcatcctcggtgtggatggcgaaggtgtggcccgcgccctcccactccaggatttctacgcagcggcggagcaccgcctcctcgctgtcctctacatagtaggccagaatcaggcccagtttctcattggaatagggatagccgggacccaccccggtctcccgggccaccagtacccgcgccgtggggggtacccgggtcaggcccgccagcttggccaccgtctccacgctcttgcccacaatggccggattcatggtgccgttgggccgcaggatgaatttggagaggaggcggtgctcctcgtcgtccagcagataggccccctgggcctttagctccgccgtgaccgccccctccatccgccgctccaccacaatggactgctcgctggcgcagatggtgccgttgtcaaaggtcttggagtccagaatccgtttgaccgccaggcgcacgtcggcggtgtggtggatataggccggcccgttgcccgcgcccacgccgatggcgggagtgccggaggagtaggccgcctttaccatggccccgccgccggtggccagaatcaggcgggtatcgtcgtggcgcatgagggcgttggtggcctccagggtgggggtggtgatgcaggaaatgctccccgccggggctcccgccccctccgccgcccggcgcaccacgttcaccgtctccaggatgcagtttaccgcgctggggtggggagagaagataatggggttgcccgccttcatacagatcatggatttatagatcacggtggaggtggggttggtggagggcaccagccccgccacaatgcccactggcacgccgatatcaatggtgcgcttctcccggttttccgccaggatgccgtgggtcttttcgtctcggatggcctcatagagggtggtggcggcaaagcggtttttaagctctttatcctcttttttgccgaagcccgtctcctccaccgccatgtcggccagccgccgggcgtgttccccggcggctgcggcgatggccgccgttattttgtccagctgctcctggctcatacccgccagcgtcctctgtgcctgcttggcctgccggagcagctctcttgtctcttgaatggattgcaaatccttgtccaaatggttcacctcgtcttgtctggcggcgggcggacacagttcgcccctgcatcgccggggcggcctgcggccgcccgccctacgtgtttccgccgccctgtcagatctccctcggccgggccgccaccgcctttaccgcctcggcaaaggcggcgcaggcggcgttgcacgcgctctgggtgccggtgaggagcccgccgccgaagttggtctcactggggggctcaaagagggcggccagctccacgtcggaggctttgagcgcctcgtccagccccaacactgcctccagaggcggggcgatcaggtaggccagggcctcaccctcccgcacgcccgccgtcttggacagataggtgcccgtgcgggagacggtgtgggcaaaatagacgatggagccgtcctcgttggccgagcggaagcccactccgctggccataaactcggcgcaggcccgcaggccggattgcacctccgccgggttgggcccggccaggatgccgatgacctcgccggccagcttggtggaggcgttgcccgcacccgcgtagagggagcggccgtacaccacctccaccgccgcggccttggtggcctcgtccagggcgcagtaggtcacgtcgtcgctgtcggcggtaatgataccaatggagcggtactgccggggcaagcccagcttttccgccagcgtctcgctgacgttggcaatggtatgggtggccagtacattggccggaatcaaatcgcctgtcataatatcacctccgttgttttgcagaggcgggcgcccacacccgcccgccggatggcgcagggacggggggagcgggccggtgtgggcatcggcccctacgatctcccgcctatttgagatctatcccgctggccttcttctccagcatggtcttgatcagctccgcaatatgcgcgcccgccgtcccccgtgcggctggccgcacggggcccccccaagcgtctctttcatctgctcgggcgaactgaattcgcccggcatcaaggttttgcccgcagggcaaaacgcttgtacgcgcaatgcgcgccccgtggaggcgggcgggcgtatttcaccgcagatcaatgccgctggcctttttctccagcatggtcttgatcagctccgcaatgtgcgcgcccgcctccaccgcggtggtaccctggcggtggatgttggagatcaccgtgcgcttggactcaggtatgccgatgtggggcttgtaggtcaggtaggctgacatggactccgccgtaaccaggccaggccgctctcccaccagcaggcacaccgcctccgcgccggtcagctccccgatgtggtcggaggcgcccacccggcagtatttgatgaagagcaccgggccgctctccaggccataggtcttgagtcccgccctggccgcctggatgcagtccaccgcgttggcctcgatggcggcagaggacaggccgtcccccaccgccagaaccactttggggttctggcccagggtctttttgatgatggcctgattggcctcgtcaaagcggcggccccggtcggggcgggtcaggtattcgtccttgttctggcacagggtctggacagggacaaagccgtttttttccacaaaggcgtcgtccacgtgggaaaacaccgagtcctgcgccgccgcgtggtcggcccgcatgcgcagcatggatagggtctgataccgggcgcccgcccgtcccaggcccagccgggcgggggtgcgcagcttcaaatccaggaaagccggaccgtttctggggtttttgaccagatattgccgccgcaaatcggtctccgtaatgtcgtccaggcagccgccggccgccgcagcggcggtcaccggggcggccttggccggggccgcagcgttgggctggcccgccagctccagcaccatgcgctccaccagggagcgcagctcttgttcgttcatattgtcacctcaatgatatagggcgggcgaacacagttcgcccctacgggatgggagtaggcggcgggggcaagcccccgccctacagggtgcgcgtgtgggccgccgattcacgccagcagaacggacgcatcccccgccagctcggtcagctttccgttctccacgaagcccatcttctccagccacgcctggaagggcgggatggcggtgaggccgtagagctcccgcagggcggcggtctcgtggaagccggtggtctggtagttgagcatcacgtcgtcgccgtgggggatgcccatgaagtagttgcacccggcggcggtgaggaggacggccagatcctcgatgtcgttctggtcggccttcatgtggttggtgtagcaggcgtcgcagcccatggggatgccggtgagcttgcccatgaagtggtcctccaggcccgcccggatcacctgcttggagttatacaaatactccggcccgatgaagcccaccaccgtattgaccaggaagggctggaaccgcttggcgaagccgtagcaccgggcctccatcaccacctggtcggccccgtggtgggcctcggaggacagctcggagccctggccggtctcgaagtacatgacgttggggccggtggcggcgccctcccgcagggcgagctggcgggcctcctcgatgagcttgccgtccaggccgaaggcctcgttgcccttctggctgccggcgatggactggaagatcaggtcgcagggggccccctggcgcaccgcctccatctgggtggtcacgtgggccagcacgcagatctgggtggggatgtcccagcgggtcttgatctcctggaaccggtccagcacccgccggacgctctccacgctgtcgtccaccgggttgaggcccagcacggcgtcccccgcgccgaaggtgaggccctccagcagggaggccatgatgccgtcgggatcgtcggtgggatggttgggctggaggcggcaggacagggtgccgggcaggccgatggtggtgttgcagtgggcggtgacgcggatttttttggccgcgtagatgagatccaggttgctcatcagcttggccacagcggcgatcatctccgccgtcaggccgcggctcacccggcggatggcgtcgccgccgtttttctcatccagcagccactcccgcagctcggccaccgtccagtgcttaatctcatcgtagatcttctcgttcacatcgtcctggatgatgcgggtgacctcgtcctcctcgtaggggacggcggggttggcccgcagatcggccagggtgaggttggccaccaccaccttggccgccacccgctcctcggcgttctccgccgcaatgcccgccagccggtcgccggacttctcctcgtttgctttggccagggcgtcctttaccgacttaaactcatacacgtgccccagcagctttgttttgagtatcatgtgatcgctccttcgcggttacgatttgttgaataccagcgtcttgatgacaactggtaataccgcgccgcccgccacgggcgcgccgatgtcgatataatcgccgttgtccacccccacgctgtccaggcagaggagggggccctccaccctctgggccatggcctgacccagcaccttggcctggtcggcctccaccagcactacgggggcgatcccttgggcgcgcaggggctccagccccccggcaatcccgcgggccagctcgtccacccgggcgtaggaggggtttccctccccccgcagggccagggcaagcgggctcagcccgccctcgtcggcaaaccaccccagcttgtcccggatgcactgtgccagggcggcggcgtccccccgctcctcctctccagtcagcttgaggatgggcaggttcttcagggggaaggcgatgtcccggtagtagatggtggagccggacagctcggtggagtggctccccgcccccaccaccgtggcccggatggtctcctccccccggaagcgccccgcgccctgaaaggccggggaggccgcgatggcccgtcccagcagcacgccgatatcgccgtaggccttccagtcgccggggggcgcgtagatgcagtcggccacgccgccggagaaggagaccaccggcaccgcccggggctcccagcgggttccctgggtgagaaaggcgtccagccggtcccgcccaggccgcaggcccgccgcctgctccagggcctccaccatggagcggatgacgggctccaacccctccggcgcggccttttgcccaacggtaggaggcgatgcccacatcgccccgcgcttcagcaccggtgagacataggtcacggttccttcccggtcaagcttgatcagccgcccgcccacgtccaggcagccggtggccgccagctctccgtgggagtacagcgccaggttggatgtgccgccgccgatgtcaaagtgtaatacatccgtgtgatgctccctggagtattcatccgcgcccgccccccgggcggccagaatggactccagatccggcccggcggtggctaccacaaagtccccggcgaactgggagagggcggagagcacctcccgggcgttttccttgcgagcggtctctcctgtgatgatcaccgccccggtgtccacctgctccggcgcaaagcccgacttccggtactcttccgccacgatggtccgcaccccctcggcgtcgatcacggtgtcggagagcaggggtgtgaagtgaatcccgctgcggtagagcacctcccgatcctcgatggcgatgcggggcaccgagaaggggttagcccggttggccagggtcaggcgggagagaatgagctgggtggtggaggtgccgatgtcgatgccgaccgataacagggtttcactcatttcggcacctccaccaccgggcccccgctctgcggggcgggcacatgcccgtaaaatcgacgcaacgcggagattttccgcagacggaattcacttccgccgaggatgcgaacatcacatggggcccccaaacaggctggcctgtctggggagacgcggcgccggtgtcgatgccgacggataataaggtctcctccatcacgccagctccctcagcagactcttcaagtcctccgccgccgcggggcgggggttggagggtgcgcagagatccgcctgcgccgcttcggccaggccgtccagcgcagcggtgagctcctttccctccactccgcaggcgctcaggcgttcgggcagcttgagctgggcgcgcagccggttcagtcccgcggccagggagcgcggattggccgccaggccgcacagcttggccaaacgtccgtatttctccgccgctgtcccatcggcggcgttgaagtggatgacgtggggcaaaatcagggcgttgagccgcccatgggggaggtgaaaccgcccgcccagagcgtgggccaggctgtggcagatgcccagcccggcggcgttaaaggcgatgcccgccaggttggaggccagcagcatgttccctttggccccgctctcccccgccgtttcccaggcggggcgcaggttctgccaggccagggtaaacgccttctccgccagggcgtcggtgtaaggagtggccccgcgggccacgtaggcctcggcggcatgggtgagtacgtccatgcccgtgtccgccgtcacggcggggggtacccccgccagcagggaggggtccagaatggcctcgtcgggcagaagggcgtcgtccaccagggggtacttgactcccttcgcccggtcggtcagcacggcgaaggaggtgacctccgagccggtacccgccgtggtgggcaccgccacaaagcggatgtccgccccggtccccagcttcttgccgaactccagcatggccttggcgcagtccatgggagagccgccgccgaaggccaccaccgcctgggggcggaactccgccagcgccctggccccctgggccaccagctccaggggcgggtcgggcaccacctggtcgaacacctccacggtgcagtcccgcaggcgggcgcgtacccgctccagcaggccggactgggccaggaaggagtcggtaatcaccatcacccgccgcccggccagcccctccagggccgccagggcgtccgatccaaagaaaattgtgggcttgagttgaaatcgttccatcgcgcttcccctgtttcttccttgatggggttagtatggcagaccaggagaaagttatacggctctcttttctttgcttttctgcacaaaaaatttactggtttttcatcagatttgacctttacaacgggagttctccggtatattattgatctgaaaaatatttagcgctaattattttttgttttatccatttaacagaggaggctattctatggcagagctccagacggagcgctccttcgtggttgagctgaccccggagggcgttcaggaaatccagtcccacaaaaatatctacaccgaggacacaaagcccattcccttgtccggccgcgagtggtccaccaagaactacataaccctctggaccggcatcctggtttccattcccgtgtatatgatggccagcgccctgctgtccgccggcctaacctggtatcaggcgctgtttatctgcgtgctgggccacacgctggtcctcatcccctccatcctgctgggaaagttcggctcccgctacggcgccagttttcccgtcctgtccaagatggtattcggacccaagggcacggccattcccaccatcatccgtgccttcatgggctgcctgtggttcgggattcagaactggatcggcggcacagctctggacgccatcatcgccgtcatcttcccggcctacaccggtctggcgttccacagcttcctcagcttcggcctgtttgtactcatcaatttctacatcggctaccacggcagccgggccatccgcttcctggaggatttcgccgcccccatcctgatcattctcagcggcgtagtcattgtctgggccttctggctggccagtcagaagggaggatttgccgcactgttcaccactcaggtggcaggcggcaacggcgagagcttctggtctcagttcttcccctccctgacttccatgatcgcctttgacgccaccatcgccctgaatttctccgactacacccgccacgccaagactgagggggcccaggtgaagggccagctcatcggtgcgcccatcatgacggccttcatcgtctttgtgggcatctgcggcacctccggctccgagctggccttcggcgaggccttctgggatcccagcattctggtctcccacttcggcaatcccgctgtggtgatcatcttctccctgttcatcatcctggccaccctgaccacgaacgtagcctgcaacctggcggccgcctccgtggtgttctcctccctctttggcaaggtgctcacctacaaaaaggccgtcgtggtggccacgatcctctccatctgcttcctgccctggaaactggttgagaatcccgagagctacgtgtatactttaaatggaaccctggccgtgttcctgggtcccatcaccggcatctgtctggcggccctgtggagccagtaccgcaaccgtctccgcctgcccgacctctactaccaggacggcggcgcctactactatcagggcggctggaacgtgctggccctggtgaccatggcagtcctgttcattttcattttcgtgtgccagtttattcccgtcctcaggtggatctacgacagctcctacctgctgggctgtgtgttcgccttcgtgatttacagcgccctgtgcaagcgccaggaccgctgaacacattggtttccacatccgacatctgataaagggggttcttatgcgtaccatcattcaaaacggcaccattgtcagcgacaccgccgccttccgggccgacctgctcctggaggacggcgtggtgaaggccgtgggggcggggctgtcggtcccggacgcccaggtgatcgacgcctccggcaagtacgtcctgcccggcgcggtggacgtgcacacccacatggatctccaggccggggcccaccgggcggtggacgacttctacaccggcaccgtggccgccgcctgcggcggcaccaccaccatcgtggatcacatggccttcggccccaagggctgctccctgtggcaccaggtggaggagtaccaccgtctggccgacggaaaggcggtcatcgactacggcttccacggcgtgctccagcatgtggatgaacgggtgctccgggagatgggggaactcgccgaccgggagggtatcaccagcttcaaggcctatctgacctatgactttggcctggacgacggggccctgttccaggtgctccgccaggccaaggaggacggtatcgtgatccccgcccactgcgagaacgatggagtggtcaactacctgcggggctggtacaaggcccagggcctcacccagcctatctaccacgccaggagccgccccgcccgctgtgaggcggaggcggtgagccgcctgctccacctggccgccatggccggggaggcgccagtgtacgtggtgcacctgtccagcgccgccggcctggccgaggtgcgcaaggcccgtgcccagcggcagaagggcgtgggcgtggagacctgcacccagtacctcaccctcaccgaggccgcctacgcagacccccaggagggcctgaaggccgtcatgtccccgcccctgcggacccaggcggactgtgacgccctctggcaggggctccaggacggggtgatcgacgccgtggctaccgaccactgccccttccgcttcgcagtggagaagcagttcggcgcgggtgacttcaccgcctgccccaacggcgcccctggcgtggaggagcggcttccggtgctgtactcggagggggtggccaagggccgcctgtcgatctgcgagctggtgcgcctgctgtgcgccaaccccagccgcctctacggcctctacccccggaagggcaccctccagcccggcgccgacgccgacgtggtcatcctcgacccggccaagcgccgcaccctcacccacgccgggctgcactcggcggtggattacacctgctatgagggtatggagctccagggggccattgacctggtgctctcccgcggagaagtggtggcccgggacaaccagttcgtgggcaagcggggcgctggacgctacctcaagcggggccacagcagcctggccgaataaatacaaaatgagcgccgccagcaaagctggcggcgctcttgcgcggatgcggggcgcggaaaacccccggccctgcgggccgggggtttgggacgcgcgtcagcgatcccacttctcgatgagggcgcggagctggtcggcgaaccgacccagatccttgttggtgccgcccttgttgtgggcgatgacctccatgagcctgcggcccacatcctccaggcgctggtaggccggcgagccgccggaggcgggctcgggcttcttctccggcggcaggccgggggagagcatccggttatccagcaggtcgtagacctcttcgtagtttggggcgtgggcggccagtcccttctcccggagggtgttggcgtagacctccgtcacctcctggtcgccgtggaccacgaacacctgcctgggccgggggctgaagtgctcgatccaccgcagcaggccgtcccgatcggcgtgggaggagaggccgtggaagttgacgatccgcgcccgcacggcgatctcctcgccgaagagcttgaccgagccgacgccgttgaggagccgtcggcccaggctgccctcggcctgatagcccacgaacaccacggcgcactccggccgccagaggttgtgcttgaggtggtggcggatacggccggcgtcgcacataccggaggcggagatgatcaccttcggggtagggtccaggttgagggcgcgggactcatcgctgctctcggtgatggtgaggccggggaactggaacagggccccgcccttgagggcggcgatggccttctcgtccagatagccgtggagatccccggagaagatgcgggtggcctcgccggccaggggggagtccaccaccacggaaaagccgggcacgctcttgacgaggccctgctccttcatctcccggatgaagtacagcagctcctgggtgcggcccacggcgaaggaggggatgatcacgttgcccccattgcccagggtctcgtcgatgatggcggccagatcggcggtgtagtccgggtctttgtccatgtcgtggagccggtcgccgtaggtgctctcggtgagcacgtagtcggcgtccctgatgtactgggggtcgcggatgatgggctgatcccggttgccgatgtcgccggaaaagaccaccttgcgggtgtcgtccccctcggtgagccacatctccacgctggccgagcccagcaggtgcccggcgtccacgaagcgcaccttcaccccgtcggcgatctggagggtggtgccgtactcgcaggtgacgatgcgcttgaccgcctcctccgcgtcgtgaacggtgtagaggggttccaccggctcctccccggcccgcttgcccttctggttctgccactgggcgtcgctctcctggatgtgggcggagtcccgcagcatgatggacagaagctgccccgtcaggcgggtgcagtagatgttgccggtgaagccctgcttcaccagcagggggatgcggccggagtggtcgatgtgggcgtgggtgaccaccacggcgtcgatgtacccggcggcaaagtccagctcctggttgtcccgctcgtcccggccctgctgcaagccgcagtccaccagaatcttctttcccccgcactccacacagtggcagcttccggtgacggcccttgccgcgccgaaaaaggtcagtttcatggggcacctccttgtgcagtttctacaaggctattgtactcctaaaaccagccggtgtaaatagtcggataacgtccggtaagacgggcagaagatccgcctccctgccgcttgggacagtgcctcgttccactcctccagggtgtaggtgttgagcggcagcacgctgagcagggtgagcagccactccgggtccgcccggccgtccagccgggccagaatgcggttctccatatgctccccccttttcccatttgtatgccgcagctctgcgtgcggtcccttttcttttgcggaaacatccagtataccgtaggatagcggtgatcggcatgaccaggaacgcggccatccagtacgccagcgccggtgtctgctgcatcgccgtccccatcttctccccagagaacgccgccgcctttgacacgacgaaccccctgtgatagactatggcggcaccatctgaggggccgcgggcccttcagaaagaaccggaccggcacacgtaggagccggtccggttcttgttatgcgttccttcttacagttttttacaggccaccctccacaatctgggccttgatcaggttggttgtgccggactgtcccaggggtacgccggcggtaatcaccaccgtatcgccgatctggactgcgttctccttacgggccacatccacagccagggagaacatccggtcggtggaatccacctcgccggacaggtaggggtgcacgccccaggagatggcaagctgccgccgggtggactcattctggcacagagccacgatggggcaggcagggcggaagcgggaaatgactttggcggtgtagcccgaccgggtggccgccaggatggccgaggcgttcagatccatggctgtcagacagcaggagtgagtgattgcgtcactgataccggataccacgggcaacaggctgcgctcccggaagcggccccaatagtcgatagcctcctccgcggcggtgacggtgttaaccatagtggacagggcctcaatggggtacttgccggaggccgtctcgccggagagcatgacgcaggaggtgccgtcgaacacggcgttggccacgtcggacacctcggcccgggtgggacggggattgcggatcatggagtccagcatctgggtggcggtgatgaccggcaggccggcccggatggtggccttgatcatcttcttctggaggatgggcacctcgtgggcggggatctccacgcccagatcgccccgggccaccatgatgccgtcggaggcggcgatgatgccctccaggttctcaacgccctcccggttctcgatcttggcgatgatgcggatattgtcgccgccgtgcttgcgcagttcggcgcggatgtcctccacgtcgctggccttgcgcacgaaggaggcggcgatgaagtcgaagtcgttgtccacggcgaacttcagatcctcccggtccttgtcggtgagggagggcaacagaatgtgcacatcaggtatgttaatggacttgttgctggacagggggccgccgttttccacctcacagtggatctcgtggccctctaccttctggacccgcaactcgatgaggccgtcgtccaccaggatgcggcagccgggccccacctccttgtggaggttggcataggtgacactcacccggcggccgtcgccgggcacgtcatcggtggtcaggataaatccctggccctgctccagagtcacggggccgtcggcaaaggtctttatacggatttcggggcccttggtgtccagaatggtggccacgggggcgcccagggtgtcccgcaccttcttgaacatattcagccgggccaactgctcggcgtggctgccatgggagaagttgaagcgggcagcgttcatgccggtccggatcagccgttcaatggtctccgcatgatccaccgcaggccccagggtgcagatgattttggtctttctcatgttcatacaatcgtccctccgtcgggtatccgaatctccaggtctcaacaaaaatccgcagatatcatacaccatcccgccccgtttgggaagggtgaaatgggttaaatttatgatttccgcctacaattttttcaaaccgtccgccaggccggacaccggagcgccgcccagcagagggccgcgccggcgcagccgcaggcgatacaggcggcgagcatccagtttgcgccgcccatatccaaggtccagccggccagcaggccgcccagcattccgcccatgccgttggaggccaccatcatcaccgtctggccccgcacccggtcagcctcgggcacggactcattgacaaagtagaccgacgccggggtgaacaggccgtagcccagcagttgcaggggctgggccagcaggacgccggcgtagttgaaggtacacagcagcgccacggccttgagggtgccgaacacagcgctgagcaccagcagccgcccgctgccaaaccggcggagcagccgtggaaagagaaaggcggtgggcagctcgaaggcccccatcacaaacatggccaggcccaagtcggcatcggtgccgccccggctggtgacgatgttgaccaggaagttggacagggggagcaccgccgtcaggctcagcagcaccccggccagcatcagggtaaaggacggattggaccgcagcagggccagggccgactgtggcctcggcccctccgcatcccgggcgcggggcctgccccggtagggcgggtaggtggccaccagggcgatctccgccgcgaccagcaccacatgggtgagcagcgtgctctccaccccggagcgccccacctggaagcccaggaacacacaggtcagggcgtaggccagggagcccagtccccggcccaggctgtagcggatggggacgccgtcgttgatgaactggatggccatggcgtccatgagtggataggaggacacctccagcccgccgatgaccgcccacaccagggcggtctcccccagccccatgcccggggcgagccagtaccagacgctcacccccagggagaggagcatggacagggagacgatacgcttgaggggaaattccgggtgccggtcggcaaagccccccagcaggggctggcacacaatgcccgccaggcagcgcaccgaggtcatcagcccggcctccccgttggaaaagccccggtccagcagcagggcggtctgatagcccacgatggaggcaaacatggcccaaaagccgatctgcatggccatatagtgccagtccagccgccggagggagggttgtctctgtatggtcaaggctcattcctccgtatgttcatattggaacaggttgtccagccgggtggtgctcgcagtgtagagggtgagggctatatccggctccaggcccgcaatggtgtccagcaaatccccctcgaaataccgcagatcgatggtggtcagctccgagcaggacagggccaggaagggggtgagggcgcaggcaaaggagtcccgcagcagcaccacccgcggcccgtccggatttttgtggttggtgatggtggcgatggggtagtcgccgccggcgtagtaggtataggggttgccgttgaaccagtcctgctgggccacccgctcggggaagcacaccgacgtctcaaaggggccggtgcgggtaaagccgtaggcggggcaggaataggtcagctcggaatcgaattttggggtatagagcgtgatgtcgtccgccccggcgtagagggagcccacccgcttgccctggctgcccaggaagaagtgctccagcacccgggtatcccagttggccggatcggtgagggccgggtcggcggccaggccgtaccgctcctccagctcgtccgtcagcgcctgccaggcgaaaaaggccgcctcgggcttccagtggtggtcggtgcggaaaaaccagttggagtagatgccgttctcctcaaacagggggcgcagatccacatagtccgttccctgccgctccagctcctccaggaacgcgtcggcgctctcgttgccgtactcctccaccccggtcgggagcagcgcctccccacgctggagcttctgtggggcgttcacgtagagataggggatgcccagagcctccaggctctgggcaaacgccgccgtggcggcggcgttctccgccacctgcggcccgacgccgggcgcggcctgaagatccacaaaattcagtccgccggtggataaccggactacggtattttcccccaccgcgtcctccaccacccggcggccggagagccgctgcaccccgccgtagagctgaataaacaggtgatcccgatccagatcgccgttgacggcggtctccgccccatccacaaaggccatcacgtccctctcccggaggaaggtcttgagcagggcctcaaacttcccctcccctccgaagaaggaggtggccagcagcaggaaccccgccgccaccgccagcaggaagaccgcggcggtcatggtattgcgtcgcttcacgcttctgcctcctcaaaaattgaagtagatgaaggggttgtaggtacccttgatcaggaaggccgccgacaccaggaacaccgccgccgccagtacggcgtagcccgcgtccagcagggggctgtcctttttcgcggcccagtcccgcaggcggggggccagcgggccggcaaagagcaccgacgccgccagcaccgtccagttctcccgcaggtagagggcggtcagatcgtcccaccccccggcgccgaggccgaacatggcctggaggtactgccccgccgccgccaggctgtccgcccggaaaagcacccaggcaaagttcaccatcaggaaggtaaacagccatttggcccacaccggccagccccggccaagaccaccatatttttccagcaccagcaacacgaagtagaacagtccccaggccaggaacgtccagttggccccgtgccagacgccggtgagcagccacaccacgaacaggttgcggatgtgtttggccttggagttcacccggctgccccccagggggaagtagacatagtcccggaaccaggtggacagggagatgtgccaccgccgccagaattcggtgatggaccgggagatgtaggggtaattgaagttctccaggaagtggaagccgaacatcttgccaaggccgatggccatgtcggagtagccggagaaatcgtagtagatctgcagggtgtagcacagggcgcccagccaggcgaaggaggcggacaggccgtccccctggccaaaggcccggtcggccaccaccgccagttggttggagaggagcaccttcttgcccagacccacgataaaccggctgcacccggcggagaagtccgcccagatctctttgcggtggtcgatctgctgggccactgtctcatacttgacgatggggccggcgatgagttgggggaaaaaggagatgtaaagccccaccttcaggggcgagcgctgcacctccccccggtcccggtggacgtccagcacatagctcagggcctggaaggtaaagaaggagatgccgatgggcagctcaataccgggaatgacaaaggccgcccccaggcggttcagaatacccagtgtaaacgtcaggtatttaaatacaaacaggataccaagattcaccgccagggcggtcacaagagggggcgcgcaggtccgtcccgcccgcttgcaggcatccacccacaggccgaagccgtaattggccaggatggagcccagcatgaccagtacaaaccagggctccccccaggcatagaagcccagggaggccagcagcagaaacacgttctgcccctgccgccacctccgcaggggcaggtaatacaccagcaggaccaccgggaggaacaggaagagaaacaccgaactggaaaagagcatgccgcttctcctttaagtcaaatacttgcccacgaacggcaccttggagaggagccacgccgccgccagggaggccaggaataccgccgccgtcagcaccggcaccgacagcacaggcgggaaggacagggcggtaatgccgaagttccgcagcagcatgaggaagaacacgtgcaccagatagatgccgaaggacaccttcgccacgccggaaaaccgctggcggcgggagcgctcgtcactcacccccagcaaatagcggaagagcacaaagaccgccgtgctcatcagggcgatgttgggactgtcatagttgtaaaaggtctgggccagcgccccgcgctgctgggacagccaggcggtgccccccacggtgaccgccgctcctgcgatccccagcaggtagatgaggtactccgccgggcggctcagtgtgtactcctttaagtaataccccagtacatagtagcccacatagcccagcaccagcttgatattcaggtagctctggtagaggctcaccgtctggctgggccgcaggcgcagaagggtgggcaggaggaaggtgaagacaaacaccagcaggaaaaaccagtggaaatccccccggcctgccccccgcacgaaggcacgcagcaccggggtgaccagatacaggccgagcagcatataaaggaaccacaggtgaaagcaggtctttcccaggagcacctgatagagggctgcccggacgctctcccagctcaggccgtgcacctgtacccgttccaccagcgcataggccgtcccccataccgccaaggcggcggcgatacgcagcatatggccgaaaaaaagcttggagggggggaggctgtgcttggggtccagcaagaacatgccggagagcatgacaaacaccggcacacaccagtgggtcagcccgtcgtacacgttgagcaccataaaatcgggcgttcccaccggcgacgcctccagggccccgccggttatgtggaccacgatcaccgccagcatggcggtacaccgcagcagatcggcgtaggccagccggccgcctatggtctgactcaccccttacccccgctccgggacgagctcgacccagtagccgtccggatcctcaatgaagtaaacgcccatatccgggttttcaaagcatacgcagcccatggcccggtgccgcgccagcagcgcatcaaagcggtcggtgacgaaggccagatggaactcctgctcccccaaatcgtagggttcggtgcggtcccgcagccaggttaactccagacggaagccggtccccccgtcccccaggtacaccagcttgaaggagccgtcgccggcctccttctcctccaccacctccagctccagcgcctgccggtagaaggccagggatcgctccagatccagcacattaaagttaaaatgattgaattgcagcatggtttttcctcttttcttcggttttgtaggcgcacacagtgcgcctctacgggcgtggttttcttccccgccagactagggcttgtttgaaacttggcgatgtgcccagcagcgagggattatggctgctggcaagcaattttttcgcgggaatccggacggatttcaaggaaaaattgcgccgtccagcggtcaaaaggcccgccgattgggcctgttgacatgtttcaaacaggccccaaagccccggtctgtagggaccggcgccccagggcagcttctcttgccccttcgtgtcagttccccttctgcccacatcggcccgccggaccaatggctctgaccgtgtcccgcagccgcgggcggatgtgggcacccgcccctacaactctgcgggtggcccaatacccccgcctccaagtaggggcggcccttgtggccgcccgcgggcgcacacagtgcgcctctacagccgctccgcaagcctccgtcccgtcggcgtcgccgccaaaccgccgctgccggtctcccggagtgaggcgggcaaagcatcgcccacggcccgcatggcgtcgatgacctcgtcgcaggggatggcgctctccaccccggacagggccatctcggcgcaggacagggcgttgaccgcccccatcacattccggttgacgcagggcacctccaccagcccggccaccgggtcgcacaccagccccagggtgttggacagggccatggcgcaggcgtgggccatctggccgggcgtgccgcccatcacataaaccagggcggcggccgccatgccggaggcggagcccacctccgcctgacagcccccctccgccccggagatggaggcgcgggtggcgatcacctgtccgaagccggccgccacatagagggcctccaccatccggcggtcgtccaggccgtccctggcctggagggggaggaacaccgcgggcagcaccccgctggcccccgccgtgggggcggccacgatgcgcttcatgcaggcgttgcactcccccgtcttgagggcggcggcgatcacctgccgcagaaagggaggacacagccccggcccctccccctccagcctggccccggcgccgccggtaaggccgctgcgggagcgggcggcggggtcatactccgccactggggccttcatggccgtccagagcgcggccatctgccgccaggagcgggcctcgtccaccccccgctcccggaggtcgtcctccagcaccgcccgccacagggggacctgcccggccgcctggagcagcccctccaccgatgaaaacgccatgtcagtcctccccctccatgttcagataggtgacccgctcgatgcccgggcaggcccgcagctcctccaccgccgccgcccagatgggctggtcgctctcgatgaccatcaccgccaggccgccccgcatatcccggtagagctgcatggtagcgatattcacctgccgcttggacagcacgccggtgacctccgccaccatgccgggccggtcctggttgcggatgatgagggtgggcagctcgccggtgaagcgggcctccagcccgtcgatggcgcacacctgcacccggccgccccccagggaggaggccgtcacctccagccgtttccccgccgcgtcctccacccggagcaacacggtgttggggtgggccccccgcagggccgcccgccccagggtcagctccatccccgccgcctccgccagctcgaaggagcgggggagccgggcgtcgtccggccgcatccccagcaggccggccaccagcgcccggtcggtgccgtggcccgtgccggtggcggcgaaggagccgtggagcagcagctctgcccgccggggcgtgctccccagcagcctgcgggtcagaaacccgatccttgccgcccccgccgtgtgggacgacgacggccccaccataatgggccccatgatatcaaagatgttcatagctgctcaaggttcctttcctgcttccatgctgttgttgggccgtcgtccggcgcgtatgcgccccgcgcctttggcgcgtacgagcgttttgccgaggcaaaacctcggcgcaggcggaattcagttccgccgagcattccaatcatttcagaggaatccgtggggcgcttgcgccccacggaaccggccccaccataataggtcccatgatatcaaagatattcatagctgctcaaggttcctttcctacttctatgctgttgttgggccgtcgtcgggcgcgtatgcgcccccgcgccttcggcgcgtacgagcgttttgccgaaggcaaaacctcggcgcaggcggaattcatttccgccgagcattccaatcatttcagaggaatccgtggggcgcttgcgccccacgggaccggccccaccataatgggccccatgatatcaaagatgttcatagctgctcaaggttcctttctctacttccatgctgtcgttgggccgtcgtcgggcggggcgcatcctgtcgaagatgttcattctatgtggatttccttgctctgtcaaggggaaacggcgcgtcagggatgccgcgccctacagctcaccggttcggcctgccagatagtcaagcgggctctccagctcatccgcgatggcgggcaagtcatgagcgtccggaaaaaggccctggatcgggagggctgcttctattatgccctggcgctgggaattgagttgggccgcctgtctgcaaaaggctgacgctcctgccccctactcatcgtcattggccttcttgtcgatgtactccggccggagcttgctgtagacgatcttctgctcgctgtagaggccgtaatagccggagagcatgtaggacacggcgatacacacggcgaacagccccaggctctggccggtgaacatgcccagactgtccccggcgaacagctccagggagagcagcagggaggtcatggggcagttggtgacgccgcagaagacgcacaccatgcccagccccgctccaaaggaggggtgtagccccagcaggggggcggcggtgcagccgaaggtggccccggtaaagaacaccgggacgatctcgccccccttgaagcccgcccccagggtaatggtggtaaagagcatcttcagcaggaacgcctcgggccgggcctcccctccgatggcggcgtggatcaccgccgtgcccgccccgttgtagtcgtaggtacccgggttccacagccacaccaggaaggtcagcgcgatgaccagcgccccgcccgcagcggcccgcgccacggggttggggaggtacttgtcgtacagccggggggcggcgtgcatcatccggcagaacaggatggaaagcagggcgaagaggacccccatgccgatgcactggagaagggtgacgggggtaaggttgggcaccccctggagggagaaggcggtgggcggcacgccgcagagctgggccacccacaggccgataatggcggagaggacgcagggcacgatggcggcgtagtagagcacgcccacactggtcacctccatggcgaacatggcggcggtcagcggagtgccgaagagggcggagaaggcggcggacatgccgcacatggtgatgatacggctgtccttgtcgtccaggtgcatccaccgtccgatcttggaggagagggagccgccgatctggaggatggccccctcccggccggaggagccgcccagcaggtgggtgagcaccgtgccggcgaagatgaggggcgccgtgcgcaggcgcaggggctggttctcccgcacagccaccaggacgaagttggtgccccggtccttctccatgccgcaaatccggtagagcagaacaatggccacgccccccaggggcaggagccacagaagccacgggttggcctcccgcagggcggtaacggcgttcagcgcatagtaaaaggcggagcttaccccgccggccgccaggccgatcaccccggcaaacagcacccatttcaggaaggtgcccggctgctccagcaagcgccgcagccgcccctccgtccgttctttggtttccatcccggtttccccctctcacgcgtacaggttattataacatgcgccgcaacttttttccgcatgcttatggatttttttcataaatatgatatactaagttctgtaacgcatggaacacatgcaatctgtcgtttcagaaagaggaggaatcatcttgcagccccctttatggcctcagcttctactccaggtcatactcatcgcaatcaacgcatactttgccgccacggaaatcgcggtcatctccctcaatgaggcggtgatccgccaccaggccgaggagggcgacaaaaaggccgcccgtctcctgcacatcgtggagcagcccaccgggtttctctccaccatccagatcggcatcaccctggcgggctttctgggctccgccttcgccgccgacaacctggccggccgcctgtcccagtggttcgccgcccagtatgccctgaccgccgccgccgaggccgcggtgcacaccctgtccgttatcctgatcaccattatcctctccttcttcacgctggtcttcggcgagttggtgcccaagcgggtggccatgaagaagagcgagcaggtggcccgcttcacctgcggggtggtggccttcctggccgccgtcatgcggccgctcatctggctgctgaccgtctccacaaatgccgtgctgcgtctggtacatatcgaccccaacgaggaggacgatgaggtatcagaggaaggcatccgcatgatggtggacatcggcgaggagaagggcgccatccaggccggtgagaaggagatgatcgagaacatcttcgaatttgacaacatgaccgccggggacgtgatgatccaccgcaccgacatggtgatgctgtgggtggacgacacggcggaggagatcgcgcagaccatcgagtcctccggcctgtcccgtttcccggtgtatgaggaggacgccgacgacatcatcggcatcctgaacacccgcgactggctgctcaacgcccgcaaagcctccccccgcccggtgcgggagctgctgcgcccggcctatttcgtgcccgagtcggtgcgcaccgataagctcttccgcgacatgcagagccggaagatccacctgtccattgtggtggacgagtacggcggcaccgccggcctcgtgactatggaggatctgctggaggagattgtgggcaacatctacgacgagttcgatccccaggaggatcaggagatcatcgccctgggcgacaaccgctggcgcattgccggctcggcggagctggacgatgtggcggaggccctggacatggaatttcccgaggacgaggagtccgagactctgggcggcctggtctttgcccagctcaacgtgatcccggaggacggaagccaccccgaggtggagctgtacggcctgcacatccgggtggaggagctgaccgaccgccgggtagagtgggccaccgtcaccaagctggccccctctgaatcggaggaggacgccgaataagcgaagcaataaaatccccccggaatcccaatgggattccggggggattttgctttttgaccggctgtgttcagcccacgtgctcgccgaagttcatcagcatctgggccacctcggcgcgagtcgcggtgccctggggatccaggacgccgttccccttgccggagagcacctgcgcattgaccgcccagctcatggccgtctgcgcccagtcggagatgctggcggagtcgctgaactcccgcacggccatcccgccctgggtggtgtcatagcccttcgcctgcgcgtagcggtacagaatcgccgcgagctgctcccgggtcacgctgtcctccggtccaaacgcgccggtgtcgtaccccttcacgatgccgcgggccgccgcccagttcaccgcgtcggcgtaccatgcgcccgccgccacgtcggggaagcccgccgcgccgggtgcctccggccgctcctccaggttgtagagtacctgggcgatcatgctccgggtcaggttcatggtgggggcgaaggtggtgtccgtggtcccctccatcatccccttgtcgtacacatacgccacggcgtcatagaaccagtcgccgctcgttacatcggtgaagggcaggccctccggctccggctccaccgccgtgaacacggcctccaccgtgaccttggaggcaggcattttgaaggtgtacttgccgtcgcccttgtcggtgagcttgacggaatcgccgttcttgtcggtgacggtcaacttgtccagctcatacccctcgtcgggcttcacggtgacagtcaccgtgctccccttggaggcgcgggtggggctcaccttcacgctgccgttgtccgtgtcctccacgctcaccgtgtaccgggtcgagccagaggaggagctgctgccgttgtagtcccactccgcagtcaggataacatccttcgtcactttgtaggggctgctcacccggctgctgccgtcataccagccctcaaaggtgtagccggagcggctgggagtgggcagggtgagctcggtcccctcagtgaccgtgtagacgctgtcctttgtatccccgtcggcatagtccagggtaacggtgtacttcttctcgccagacgtggcgtttacctcagtaatggtgtcgcccggctgggcggcggcctgggcggcctccaggctgggatagtagctgtagggagcctcggggttggaggcgctctccaactgggccttgacgctgtcagccaaatagtcctcgttgacgggcttggcaaagtgaccgctggtaacctcgatgccgctctttgcagcctctgcggccccgctggccgcctcaatggcaccgaaggtgccgttgccctgaatggtcagcttgtgtgtgtccgcgtcggtgctgtcatacacgatcttgccgttgatggtgccggtgtagctctcatcaaaggtgacattggtagaaggatagctactatacttacagacatcaaacgcaatggcttcgtcgctggtggtcacgatatccgtatctcccttgaagatgatgctgccattgttgaagctcagcgcgtagtcctcgccgtccgcctgatgctcggcgaagaagtgcatatcctccagggtcaggtttgcatagttctgaatgatgcgcttgatggaggtcgtgccctcggcaatacggacggtgccgtttttgagggtgatggtggaatccttcaggaactggaatccattgctctccgttccggcagagcccgctcccgggtccttcagggtataggtgtggccgccaaaatcaatggtaaagttcttaccagagggcacggcaatgccggccgcctctgggatgtccttcaggacgtagatggtgtccccggctttggccgctgtgatcgccgcacccaaggtctcataggtcttgccgcccaccatcaccgccgcattttcggcagtattcgtggtcagagttccatccacagtgctgttgacaatgacgatcgtttctgcggtggtgccctcgggcacgctgccgatggtgctgttgaccacgctcatggtgccgccggcgctgttggacacctgaccgtccacggtagcgccgtcggtgatggccacatccgccttgccgctgttggtcacgtttccgttaaccttggccttctgggtaatggtcagccgggcgccctcgctgctgtccgtgaggacaatggagccgttcagcgtgccgccggtgatctcaatatcgccgctgtgggttccaccgcccattgtggtgattaccgtcttttccccggcgttgaaggtaccgccgttgatggtcagcttgccctgatccatggtgccgtcgatatagccgttcagaatgacgccgttggaggcgcccgccgcatcgaaggtaccgccgttgacagtggccacattccagttcaggaacgctgcctgggacatgctggtaaaggtgccgtcattgatgaccagctcgccatagtcgtcgttcttgatcgtgttcaggccgccggagaaggtgcctccgttgatggtcagcacggagttttccttgcccgtattctgacttccgttataccagccgttctcaatcatgctggagaactggccgttctgcgtgacggaaactccactattgatctccatggtgccgtggttgacgatgttgtaataggaattcccgccgctggcttcggcattctgtccgttctctttactgcgggtatacgcgcctccgttgagcaccacattgccgccgggctcattctggattgccgctctggcgtgggtcacgttgtccaccgtgccgtcgccggtgatggtcagagtgcccttgttggtaatcgtgtggtcctcgtggttggtcaaggtctttccgttcagattgagggtcagctccgctccctcggggattacgatatcctccgccgtatcctggagcagagtaaccgtctcgttcttcccggcgttgtcgaccgcattctggaggctggcgtagtacctaccgcccacctcggccacaccattcgtttcatccagttcgtttacggtaaacgtaccgtctgggccttcggttatcgcggcattctccgccacatacttgctcacatcactggagaacgtgccgccataaatgatggggttaccagtcttttccgcacctttcagggccggcactccttccggggccttaaagacgccgccgttgatgaccgcggtggccttttcattgatgcccccgtccccgccagtgttgtcgtttccaatcagagccgcggtatacgttccctctgtctcaaaggtaccgccattgattacggcttttaccacgccgacctcacccgccacatagagggcgtagaacgtggccgtgtgcttggaatcgttgacacacttgaccgacttaaacgtaccgccgttgatttcgaagtaccccacagaagcggataccgcgccctgtacccctgtaaaggttcccccgttgatggtcatttgggaatcggcagctccattctggatcgtatatccccaaacattaccgttgcactggctgcacgtagtccccgtgaaggttccgtcttcaatcgttacggtaccctcgttataaaccgcgcatgtagccttctcaaaggttccgtcttcaatggtcagtaccgcggactcccctgtgttccggattgccgcgccgccggcataggtcgctccgcgataggttccattttcgatcgtaagtatattttggttgttgattgcgcccactccggtttcagacgcagatgaatcaatgacgccgtcgcctgtcaccgtaagagtacccttgttcacaatcggcctgcccgtaaagttcgacgccacggtgatgctgtggcagtccatgtccagcacgatgtttttcttctctggaatggtgatgatctgatccgtggtcatcccggtgatatcgcccgtcaggacgaccgtggtctcctccccatctggagcggcttcgatcgcctgcatcagcgcgtcataggcgcctttttcctccatcggcgcaggagccgcttcctccagcgtgtccgctgccggagtctcttccgcaaagacagtcataggaagaagactcagtagcatacacacagacagtagcgccgccaatcctttttttgcccgtttcatgttgttcctccttttttaaattgcgccccggctccactgctgtcagttgttattgtcttttgctagcaaaagacagaagtgtgccggcacacttctgtcttttgctagcaaaagacagaagtgtgccggcacacttggcatccttactgtatcacattgtcccaatattttcaagagggcacgtccacgcaatccacttatgcgttccgcagcagctccctcgcccgggccaacagcttggcgtacacgccgtccatctgccactcgttggtgtactccagcaggcgctccgccggaagccagcccacccggctgttctccccctcccggatctggagggcgtcgcgctcgtcggccaccagcaggtaggatacattgagatgctgatgggagggcacccacttcccgcgcttcacgtggccccatacgggcagaatgtccagggaggcgatggcggggctgaggggacggatatgctccacccccgtctcctcccgggcctcccacagggccacggagagcaggtcgccctccccatccgcatggccgcccgtccaggcccacaccctgtaaatattgtggtgggccatgagcacccgggtgccgtcggcattgaccacaaagccggagctggacagatgggcgatctcgttgtcccgggtgagaatgttgtccggaaacaggcggatgtactccagaatcagccgctgatccgccgcctcctgctcattttggggcgtataggcccgaatttcatccacatacatggggcttcctcctccggtagatcacatagcggaaggggatgcccgcgtgctcctggggctccccctcctcggccatctcccagtccgggccggcgtccaaatctgggaaaaaggcgtccgccccctcccacgcccggccgattttggtgatgtaggccgtgtcgcaccagtccagcagggccgcatagacgctctcccccccgatgacgaaggaatccgccggggcggccgcccgcagggcctccagcgaccggaacacctcggccccctcgggggcgaaggcggagtcgcgggacaggatcaggttccgccggtttttcaggggccgcccgccggggaaggtggccagggtcttgcggcccaggatcaccgggtggccggtggtgagggcctgaaagcgcttcaaatcggccgggatgtagcagagctgatccccgtccctgccgatggcccagttcaagtccaccgccgcgatcaaattcatcgggctccctccttataccgccacggggatgggctgctccagcgggtggaagcggtagccctccaggcggacgctgtccttcgtgaaggtgtagaagtcggtaaccgccgggtccagccacagcctcggggcctcgtagggcgtccgggcgatgagctcctccaccaccggcacatggcggtcatagatgtgggcgtcggcgatgacgtgcaccagctcccccgcctccagccccgacgcccgggccaggaaatgcaccagcacggcgtactgcatcacgttccagccgttggcggtgagcatgtcctggctgcgctggttgagcacggcgttgagggtgcgccccgacacgttgaaggtgaccgaccaggcgcaggggtagagggccatctcgctcagatcgtggtgattgtagagactggtgagaatccgccgggaggccgggttgtgcttgagatcgtagagcacccggtccacctggtcaaactccccctcggggtagcggtgcttgacccccaactggtagccgtaggccttgccgatggagccgctctcgtccgcccaggcgtcccagatgtggctggacaggtcgtggatgttgttggacttcttctgccagatccacaaaagctcgtccaccgcgctcttgaaggccattttgcggatggtctgcaccgggaattccgcccgcagatcgtagcggttgacaatgccgaatttcttcaccgtgtgggcgggggcgccgtcagcccaccgggggcgcacctcctgctccgtgtcccacaccccgttggccagaatctccttgcaattttcaatgaacagctcgtccgcgcggctcatatcgttcctcctccggttggttttccccagcataccacattccgcgccggaacgcaaacccaccggttcggccaacggccgggcgcagctccgcgcccgcgggcggccataaaggccgcccctacgttccagcaccgtcccccaattttctcccatacaggccggtgcggcgggggcgttacagcgtaagcccccgccgccggaaagccgccagcggagcagcctgggggaagttccaagaagggggaatcgcaattcccccttcttggccgtttcaaggggtggattgttaagacgggggaaatcggcaccgcagcgtaaagcaaacgtgccggtggcacgtttgcagcgtaggccgcagtggctttgccgcggggagggaaccatcacaggggcccgccggaggcatgacaagaaaacaggtgtcaaaaagggtaacatggaaggcgcttcagcctggaataaggtgggccgatgtgggcagaaggtgaattgccctgaaggggcaagagagtccgccctggggcgtcggcccctacgctaaggggacgtccgcctcaacgtatcacggcgtaggggcgacccttgtggtcgcccgcgggcggccataaaggccgcccctacaggccgtagtaccggcacagccgggccactgcttccatagcgtcgggcggattgacccacaggtcgggggcgtatcccaccccgtcccggttttccatggtctcatgaaagcccagcccggtaccgaagaaaaccgggagtcccgaatttggcaggcagcaggtgaagttatccgacaccagggagcagccgcccgtgtttacccccaccaccagcgtgttctccaccgtgtgcaggtcggtcagcacgtcctctccggcggaggcggtccagttgtccgtcaacaggaaggtgattccctcccgctccacccatcggcctggctgtgaggaaacagcccaggttcccatggcctcgtccggatagtccagaaaatagcaaccgatctggctgatcctctttccggagctccggcggggctgggcgggctggcccgtccagccatcaaaccactccgccatccagttcgagtacccgccggggttgctccgcacatcgaagatcagcaggggcgcgtcggcgtactccccgccgcaggcggcaaaccgcgccagctgttcctcctcttccggcgtgtcggcggacatatagcgggattgcagcgttgggatgccctggtattcgctctccgcaaacaaaaatgaccggggcccacagtctcacagggcgtccacgacagctcatacccgcccagggtgtccggcaggtcgctcccgtccttgctcatggcgaaaaagccgtaggtgatggccccatccgggccgatggtgggcttcacatagtcctcacttagcccagtggggtcgctgatgtatatatccggtacataataggtacggagcttggaaaacaggtgactgcctccaatcgtaaaatgtccgtccagtaccgtcccctccagcggcaaatacagggccgtcgccagccggataagcgtggaaccgtaaggggtggtggtgtcctccagtatctcgatgctctccgccttcaacttctcaaacacctcatcgccgccgaagtactcgtaggccccgtaggtggtgcggaggagggtaaagaacacatccagatcctccctggccttctctggagggagatagtccaccatattgcggcgggtcatcagagcctccatctccccgtcggtgaaggtgtggttctggccggcaaagtccggcgtccagggggagatgtccaggggctccccctcctcgatgacggcccggcgcttctcgttgaccgcgtccagaaaggcgtggaagtccaccgccgcggccggggtgggtgtgggctcgggtgtgggttccggcgcgggggcgcaccccgccagcagggcgaggctcagggccagggggaacagcctccggttcattccagcacgcttcctttcagtccgtcccgatgaattcccgttatttttacctcttttatgacattatgtagtccctcgcccggggcaaagacctccgtataattgggggcgtggccacgccagaggccctccttctcctcctcgaagagcacggtcagggtctcccccacccagcgctccagccaggccgcccgcagctcctccgccaccgccgccgcccggcgggcccgcgcctccttttccgccttgggcacctggccgggcagggcggccgccggggtgccggtacggcgggagtaggggaagatgtgcatggcggagaaggcgcaccggcgtacaaagtccagggtctggtcgaactcctcctccgtctcgccggggaagcccacaatgagatcggtggtgataccgggtcgatcaaagtgttcccggagtaatgttacgctctcataataccgggcggaatcatatttccggttcatccgcttcaacgtggcgtcgcagccgctctgcatggagaggtggaagtgggggcacaggttgggcagggcggcggcccggcggcagaagtcctccgtgacggtgcggggttccagggagcccagccgcacccggcactccggcgcggcggcgcacaccgcctccacaaggtcgatcaggccctgcccatttttgagatcgtgtccccaggaggagatttcgatgccggtgagcaccagctcccggtagcccgccccggcaaggcgctttgcctcacaggcggcctcctccaagggaagggagcggatcggcccccgggcgtagggaatgatacagtaggtgcagaagttgacgcagccatcctccaccttgagcatggcccgggtgcgcccttccaggccgccggcgggcagatgctcatactggcggcggcgcagggcgtcgtccacccttaccaccgggtgtccgccgtcggggctgagggcctccagcgcgtccagaaagcccatgcggtcggccgtgcccatgaccagatccacccccagggcctccaccgcctccggatcggtctgggcgtagcagccgcacaccgccaccaccgcgtggggggagcgcttgcgggcctgccggatcatctggcgggacttcttgtcgctcaccgccgtgacggtgcaggtgttgatcacataggcgtccgccgccccgtcaaagggcaccagggcgtggccccggccggtgagctccgcctccatcgcctgcgtctcgtattggttgaccttgcagcccaaggtgtagatagcaactcgcatgtcttttcctcgcatatgaccgcggctctttgtgaaaaaaacagaatttccggtttaccgcggctttcccattgaattttttccccgttcctgtctataatgaggataccctaattataaagcaaagccccaccgtttgtatacagtcatttaggaggtgccctttcatgtctgagttcttcgtgtcgctgtcctccatcgaggatgtacgccagtttgtcaacgcggccacctgctgcccctgcgaggtggacgtgctctccggccgatacgtcatcgacgccaaatccatcatgggcctgttctccttggatctctcccacccggtgaaggtggaggtccacggctccgacgccgatcgctccgcctttgagcagagtgtcgccgcctttgaggtcaagcagacccagtaatataagataaggagggcggccctgggccgccctcctttttcgacggtttacaaaccggccgcttctgtggtagaatagtttgctttcgcaggagggatgaccatgtcagaccagtacccgttcttcgcctacctctcccggatgcggtacatcaaccgctgggggctgatgcgcaacacctttcaggagaacattcaggagcactcccacatggtggcggtgctggcccacgccctggccgtgatccggcgggacgtgttcggcggcgacgccgaccccggtctggccgccgcagcggccctttaccacgacgcgccggagatcctcaccggcgacctgcccacccccatcaagtactacaaccccgacatccgggacgcctacagggaagtggagcagttctccgccaacaagctgctgcatatgctgccggaggccctccgcccctcctttgaccccctgctgcgggagggctacgaccccgggctcagaacactggtcaaggccgccgacaagctctcggcccacatcaaatgcgtggaggagctcaaggcgggcaacgccgaattcaagcaggccgcggagcagacgctggaggccctgcggggctatggtctgcccgagctggactactttctggagcacttcctgcccgccttcgggctgacgctggatgagctgcagtgagagtcccccatatccgtaaaaaccgcaaaggagctgttctattatgagagcaatcgtcaccgttctcggcaaggaccgggtgggtatcatgtccctggtctgcgccctgctggcccagcacaatgtcaacattctggacatcagccagaccatcctccagggggacttcaccatggttatgctggtggacgccggcgcctgcgacatccccttcgccgagctggccgccctgctagagcgggagggtgaggcccgcagcctggacatccgcgcccagcgggaggatattttcaacgccatgcaccggatctgaggaagcgcggagggtaggcgcataggggagctaagaggacatgaagacgaaaaaacaggctgggcgaagcccagcggcatttttcgcggaatggccgcttagcgacccggtcatgcgcccaacccgcagcgtgacaggaagcgcggaggcgtgggtcgcagccgcacagcgcgccccgcagacgaaaaagcagttgcgccgcaggcgcaaggtgtttttcgcggaggggtaagcagtgtggcgtcgcgcagccgccgcagcgtgacagcgtcggcccaagctttggatcattcgcttccgggcaagcccgaacgctcactcccgccgctgggcctccttttccccacgcgaaccgcttcgctgggttcgcgcgggggccccgaaagcggggtgcacccctcaccgatatgtaggggcgggtgcccacacccgcctgcgggccggtgagggcagaaggtgaattgccccgcaggggcaagagaggccgccctggggtgtcggcccctacagcgggacgtctttgggagctgtaatgtaggggcggggcttgtccccgcccgccggaaccgcccacgcttcagttgattttcaggaggaattgacttgatcaacaccaacgaaattttggataccatacatatgatcgaccagcagcatctggacgtgcgtaccattaccatgggcatctccctgctggactgcgccgatcccgatccaaaggccgcctgtcagaagatctatgacaagatcacccgccgggccgagcacctggtggccaccggcgaggccattgagcgggagttcggcatccccatcgtcaacaaacgcatctccgtcacccccatggctcttgtggccggggcgtcggagacgggcagctacgtccccttcgccgtggccatggacaacgccgccaagtccaccggggtcaacttcatcggcggcttctccgccctggtgcagaagggggccacccaggccgacaagaagctcatcgcctctatccccgaggcgctggccatcaccgactttgtctgctcctccgtcaacgttggctccacccgggcggggatcaacatggacgcggtggccgagatgggccgcatcatcaaggacaccgccgagcgcaccgccgaccggggcggctttggctgcgccaagctggtggtattctgcaatgcggtggaggataaccccttcatggcgggcgccttccacggcgtgggggagccggactgcatcatcaatgtgggcgtgtccggccccggcgtggtgcaccacgccctcaaggacgtgaagggccagcccttcgacgtggtggccgagaccatcaagaagaccgccttccgggtgacccgaatgggccagctggtggcccaggaggccagccgccggctgggcgtgccctttggcatcgtggatctctccctggcccccacccccgccatcggcgacagcgtggcccgcattctggaggagatgggcctggagacctgcggtacccacggtaccaccgccgccctggccctgctcaacgacgcagtgaagaaagggggcgtcatggcctcctcccacgtgggcggcctgtccggcgccttcatccccgtcagcgaggacgagggcatgatcgccgccgcccgctcgggcgccctccacctggataagctggaggccatgacctgcgtgtgctccgtgggcctggacatgatcgccgtccccggcgacaccaccgccgccaccctctccgccatcatcgccgacgaggccgccatcggcatggtcaactccaagaccaccgccgtccgcctcatccccgcccccggcaaggtggtgggggatacggtggaattcggcggcctgctgggctccgcccccgtcatgcccgtccacgccgagagcagtgacgcctttgtggcccgcggcggccgcatccctgcccccatgcagagtctcaagaactgacgcggccgcccaatccccgttgtccttctccgcgcccggcctgtgccgggcgcatttttttgcttcaaaatttccaaaatccccctaggaaagcggcctgctttggtgtatactgggagccaggacaagccttattttgaggagggtcaatttatgttagagctgaatacttccaactgcaccccgtttctgcccgaggactggctgaccagccggctggacgcgctggagagcgcccgcgtcaagctggaggagggcagcggcctaggcggcgcgtataccggctgggttcacctgccccgggactacgacaaggaggagtttgcccgcatccaggcggcggcggagcgcatccgcagcgactcccaggccctggtggtcatcggcatcggcggctcctatctgggcgcccgcgcggtggtggagctgctccactcccccaatttcaacctgacccacaagggcgggcccgacatctactttgccggcaacggcctctcctccgacgccatgctggaagtcatcgagctggtgaaggacaaggacttctccatcaatgtcatctccaagtcgggcactaccaccgagccggcagtagccttccgcatcttcaaggccctgctggaggagaagtacggcaaggagggggcccgcaggcgcatctacgccaccaccgacgcccacaagggggccttgaagggcctggccgacgcggagggctatgaggagtttgtggtgcccgacgcggtgggcggccgctattccgtcctcaccgccgtgggcctgttgcccatcgcctgcgccggggtggatatcgccgccctgatggagggcgccgcccaggccatggaggccctggccgcccccggtgcggacaacccggcctggcagtacgccgccgcccgccacgccctgtatacccagggcaagaaggtggaaatcctggtggggtacgagccctccttccgcttcttcggcgagtggtggaaacagctcttcggcgagaccgagggcaaggacggcaaggccctcttccccgccagcgtggagttcaccgccgatctgcactccatgggccagtacatccagcagggtgagcgcctgatgctggagacggtggtgcgcttcgcccgcagccgcggcagcgtcaccattccacacgacccggacaatgtggacgggctcaacttcctagcgggcaaggatctctcctttgtggccgaacaggccatgcggggcaccctgctggcccacgtggacggcggcgtgcccaacctggtggtcaccgccccggcccgggacgcgcagagcgtgggctggctgatctacttcttcgagtacgcctgcggcctgtctggctatctgctggagatcaatccctttgaccagcccggcgtggaggcctacaagaacaatatgtacgccctcctgggcaagcccggctatgaggatcgcaaggccgagctggaggccagattgtaaggcctccacaccaagcgttttgccgcaggcaaaaccttgatgccgggcggattcattccgcccgagcagataaaatctccggggtccccatagaaccctggttctgtggggcggcctacaagaacaacatgtacgccctcctgggcaagcccggctatgaggaccgcaaggcggagctggaggcacgcctgagctgattctccccacctccgggcttgcccaggggacccgccacaggcgggacggcgcttttgcgccgcaaggcggagctggaggcacgcctgtaagaacccccgttaatttttggtgaacttccgcaaatcagttgcaatcgggccgcaaaaatggtaacataattgcacaaggccggagatacgctccggcggacaatgaaggagtgataactatggtgagagtgatcatgggtgtcaagggcaccggcaagaccaagcagatgatcgagctcattaattccgctgtccacagcgagaacggcaatgtggtctgcatcgagcggggccccaagctgacctatgacattcattataagatccgtctggtggaggccagccattacgatattaagagctatgacttcctgaagggctttatcagcggcctgtacgcgggcaactacgacatcacccatgtctttatcgacagcctgaccaagattgtggcctccgaggccaccgaccatgcggtggaggagttcctggactggctgaacagcttctccgagaagaacaatattaagttcaccgtcaccatcagcgccgatgcctccctggccaccgacggcgtcaagaaatacttctgatacgtgccctttcagcgggccctgccggcggcagggcccgctgcctcgttcctccctccttccggcgtcaaatcgcttgtacatccggcataccgccgcagaactttggataatataccgattgcgtgggattacctcccatgatatactctttggcgaaataaaggaggtgtgaatcatgatgattgaaatgcagtttaactccattgcccagctccagcggcttcaggagatcgccagttcctgtgacgacgagatcttcctgcactccttagacgacagcgtccgcgtggatgccaagtccttcatcggcctgttcaccctggacttcactcagcccgtcaaggtggtcaccgattccgactatttggcccgcaaggtggagcatctcaagcataagatggagaaataaaaacaggcgttggccgctggccgacgcctgttttgctatgcaaaagcatagcaaaattggccatgtgccgcttacagcgggacggcccatatgcgcagaaacttcatgcgcctaagcctttgcataatttcgtggtgcgccctgtgcgcataaagttttatttcctgatccagtccgggtgcgttcatgcctcccggcggcgcaggagcgcccggagcgcacagagcgccgcggccgccgccagggccagccacaggagcaggaggacgttctcattgaagtaccagttctccgcccatcgggtgaaatccggccggaaccagaagccgtggagccgctccaccgtcccgccgcccagccgcaccagccggtcgatcaccgggttgaccagggggaggaacacgcaggccgcccccaggcaggccgtccccttccaccagcggctgatgggggcgtaccggcagatgagcacccaggcccagggcagggtcaggccgaagagaaccgccggcagggtaggaatggggaaccaatctgcgccgtcataggcacaactgacccagagcagggcgcacagcagcagggtctccgtccccaggtagagcacagccttgtgctcccccagggggcggggcagctcccgcagggcgccgggcaggaaggccgcccccagccccagcagcacccccgccgaggccagcaggaaccagtctcccccgctgaacaggcaggcggccagcagcagcagctccagcgagagggtgaagccccccagcgtgatgacgccccggtactgcttcaccaggatgggcaggagggtgaggctggcccccaccagttccccggtgagtaccagccagaaccagtccagggtatgccccaccgccagattgcagatgaggcagatcagggcggtgccgccgtagaggatgtactgaatccagcgcaggcggcgcagcagggacaggtattttttcgccagggtctcggcggtgcgggcctctacgtcctcgctggcggtgagcagctcgtgctccgacacctgtaaaatggcgcagatatcccggatcagggtgatgtccgggtaggacatacccctctcccacttgctgaccgccgactcggtgacgaagagcctgtcggcgaattcccgctgggtgagccctagctccttccggcggcggcagatatacgcgccgaaggtctttttgttttccatgttgaaccatcctttcggcagggtgtggtcttgcaaggccgctctcaccatacggcgaatggcggaaatttgcaaggccccggcgggattttccccctcgaccgttaggaaagtcctgatttttcaaggggtttcggccctcccggcacggcgggccggatgtccatgccgtgggctaatctccctcgggcaggggcacccgccggtgctccaccggcccccaggcgggcaggggcaggccctgcatggccccgaacacccggctcttgaggccgggatactgcttgtccagggacttgatcagctccttgacctcctggcgcttggtattgccgtccgccgggcaggggttgaacaccacgggcagatggttgcgctcggcggcgttgcggagcatcccctccccacagtagagcagggggcggatttgggtgatgccggtgcggtctaaataggtcacgggctggaagcaggacagccgcccctcataaaacagggagaggaagaaggtctccaccgcgtcgtcaaagtggtggcccagggcgatcttggtgatgccgtgctccctcagggcgttgtggagggcgccccggcgcatcttggcgcacatggagcaggggttcttctccttgcgcagatcaaagatgatgtggtggatttcgctgtggagcagcgtgaagggcacgtccagctcccggcacagggcctccaccccggtgaagtccatcccctctcccccgtccacatggcccatatccagggtgtaggcctccacggtaaagggcttggggtagaactcccgcagcctggccagggccaccagcagggtcagggagtccttgcccccggatacccccaccgccacccggtccccggcctggatcatgtcgtagtcctccacacagcggcggacatagctcaaaatcttgttcataggcacctcaaaaattaaaaatcgaaacggagcattcaagagtatttgcgagatttcgcgcgtttgagcgagcattcttatttctaaattaaaattttcaaaaaacgtgttgacaccttggaaccaccgtattataatacaaaacgctccggtcgtccagattggggttcttattctgttgagacatttttgatcatagaacgcaaaattggaggtttcaccatgtccacttttatggccaacaaggggaacatcgtccgcaagtggtatatcctcgatgcggcgggcaagcccctgggcaagactgccgccgctgcggccaccctgctgcgcggcaagcacaagcctgagttcaccccccacgccgactgcggcgacttcgtcgtgatcgtcaacgccgagaaggctgttctgaccggcaagaagctggagcagaagtactaccgccgccactccggctggatcggcggcctcaaggagaccaagtaccgcctgctgatgcagcagaagcccgagctggccatgcagctggccgtccgcggcatgctgccccgcaacatcatcaccaaggattctctgtcccgcctgcacatctaccgcggcgccgagcatccccacaccgcccagaagcccgaaacctgggccgccatctaagcaggaggtacaaaggaatgtataagagcaagaagccttatctgtatggcaccggccgccgcaagtcctccgtggcccgggtgcatctgttccccaacggcaccggcgcgatcaccatcaacggccgcgacatcgacgattacttcggcctggagaccctgaagctgctggttcgccagcccctggccactaccgacaccctgggcaaggtggacatcgttgccaccgtcaccggcggcggcgtgaccggccaggccggcgccatccgccacggtgtggcccgcgctctgttgcaggtcaaccccgagttccgcgccgccctcaaggccgccggtttcctcacccgcgatcctcgcatgaaggagcgtaagaagtacggcctgaaggccgcccgccgcgctccccagttctccaagcgctaatttttcgcctgaccttttaaaatgccgcccatatgggcggcattttacttgcgctttcagggctctgcggcggtatgggcgccgcttgcttctgcgggtatgggcggatgactccggctcggatattgcaggaaggagagcctgcggcacagaaatcgggagattcctcccacagtcagggcacaaactattgtcccctcccgcaggccgcagatggcccccaggctgagataggagagcagggcggctgccgacaccatagccagatcatagccggtcttggtcttcccaaaatcccagccgaatacctggctggcggttcggacaaacccctcacatggcaggatcagcacattgggaagcacctccagcgcaacccccagccccagggagagacagcccagcaggagcaccacccacctggccccataggactccggcaccagcggggccaacagctccgtccacaggtcgatgcagaccgagaagaggagcgtggccggaatctggaggagctgtatggactgaaacctgtgccggagcaacagcacctggccgaccagcatggtgcagttcaccaggaaggtaaacacccccagcgagagccctggaaagacaaacgtgaggacataggagaggctggacaccgccgaggtgcccataccggctaaggtaatcagggcgattcccagggcggcgcagagaactccgcagaagaacagaatatagcggcgcagcaggctgggctgtctcataagcctacccctccttttataaaaaatattttttagatataataatattttagcatttttaaaaattacgttcaattgtcggcctgcccaaaaaaccacccccatttttgacatccggcgccgctgatacaaatgttctttgacatgccttatacaatccgctatgcagtgtagagaccgtgtaaagaaacgcccgacctccggtatccaaagggttttccacattatccacatggttatccacatcagttaacaccctgtggataacgccaatatgcaaaattcagttgacataagacaagtcaagcaaaaaatccacggcggattctacaaacttttttgttctccatttttcttccaattgtggtacaataacgtcaggtgtcctgaacatatcatgagccgccgctcaatcatgaggtgaaagcatgtccgaacccattgccgccattgccacacccccggttcccagcgccattggcatcgtccgcgtcagcggagagggcgctatcgaggccgcgtccgccgtgttccgcgccgccagcgggcgtcccctggctgcctgcgagagtcgcaggctggtctacggcaccctgctgggccccgacggtgcccccatcgaccaggtgctggccacgctctcccgtgccccccacagctacaccggcgaagacacggcggagctgcagtgccacggctctcccgcagtgctggcgatggcgctggaggccctgtttgcccagggcgtccggcaggccgggccgggggagttcaccaagcgggccttcctcaacggaaaactggatctgacccaggcggaggcggtggcggatctcctcgaggcggagacccccgccgccgtgcggcaggccgccggacagctctccggcgcgctgagccgccgggtggccgccctctacgacggtctggtggatctcatggcccactttcacgccgtgctggactatccggacgaggacatcgaccccttccgggccgacaccatccgggagggcctggacgccgcccatacgggcctggaagcccttctgcgcacctatgaccggggacggtatatcgccggcggcgtgccctgcgtgctgataggacggcccaacgcgggcaagtcctccctgctcaacgccctggtgggctatgaccgggccattgtcaccgacgtacccggcaccacccgggacacggtggaggcccggtgccggctgggcggcgttgtgctgcggctcatcgacaccgccggcctgcgggagaccgacgacgccgtggagcgcatcggcgtggaacgcagccgggccgccctggctggggccgccctggccctgctagtgctggacggctccgcctccctcacccccgaggatgaggccgccatggcccaagccgcccgcgccccccgggtcatctgcctgatcaacaagtccgaccgccccctggctttcgcgccggaggagctgcggagccgctttccccatctgtgtgtggtcagcgccgccaccggcgcagggctggatgcgctgggggagaccgtcgccgccctcttccccgctggaggcgcggagagcgccggagagctgctcaccaatgcccggcaggccgatgccgcccggcgggcgctggaggccgttacgcgggcctctgagagcctggaggccggtatcacccccgatgccctcctcaccgacgcggaggaggccctcgccgccttgggagagctcaccggggccagcgtgcgggaggacgtgaccgcccgcatctttgagcgcttctgcgtgggaaaataggacgcatggcccgccgcccgccggggcatcctatcgggtgaaaggagcgatgcacatggaggtctccatcgagcgcagcgactgtatcagctgcgggctgtgtgtctccacctgccccgacgtgttccggatcgcggaggacgggttggcggaggtctaccgccagcccggcccggcgcacctgcccgctgtgaaatccgccgccgagggctgcccggtcagcatcatctatctggaggagtgacgggtcaagcacgacaaggggccgctgccaatggcagcggccccttgcggttccttcggttgtcacgcctcacaccctccgccacggcgcactgctcaccgctccgcaaaaaacaccttgcgccttcggcgcaacttccataaggaagttgacacccgctgaaaaaagttgctttccggtgggtgccgctttataattgtctcaccggcaaatcaaaatttggggaggagaggactcagcatggaaaatgaagttatattaggaaatgtcatggttgattgcgatgacgaaaagaaattgcagaaattttatggtgagttattaggttgggaaatgtgcgaattatttgcaagacctgctgtacgcagttctacgggaatcgtttttctgttcattgaagaagctgagtatatttgccctgtatggcccgaagaaacagggaaacaacagaaacagatacattttgattttcaagttgataatgttatggaaatggttaagaaagcagagcggttgggagcaacaaagtcaaaagcacaatttggcggaagtgattttgtaacaatgtttgacccagcaggacatccattttgcctatgccaaaagtaacaaagtacagtttatcgcttctcccacgaatactttccttgaaagtgtcatagtgggttacacagtataaaaaggacaaggcagaccgttgcggcctgccttgtccttaacttctctataaatccttacacttcggcgcaactgcttttttgtctgtgcagctcgctgtgcgcctgctcccgggcgttcagcgcttcgctttactggagattgaagaaggcgtccatacccaggtactgcgccacgtcgccctcgtcgtcgcaaagtccgctcccgtcgggacgcccatgcgtgggcatccctccctccgctcccttgctcctcctctccccaaccgacccactgcgttgggctcggttggggaccccaggagctgggcgactcaaaaagcggggccgctgccaatggcagcggccccttgcggttccttcgtttatttgaggttgaagaaagcgtccatacccagatactgcaccacgtcgcccagctcctcctcgatgcggagcagctgattgtacttggccacgcggtcggtgcggctgggagcgccggtcttgatctggccggcgttgacggccacggcaatgtcggcgatggtggcgtcctcggtctcgccggagcggtgggacacgatggcggtgtagccggcccggttggccatctggatggcgtccagggtctcggtcagggtgccgatctggttgaccttgatgaggatggcgttgcccaccttcttctcaatgccggtcttgagccgctcggtgttggtgacgaacaggtcgtcgcccaccagctggacgcggtcgccgatggccttggtgagcatggcccagccctcccagtcggtctcggccatgccgtcctccagggagacgatggggtaggtgtcggcaaacttcttccacatgttgaccagctgctgctgggtcagcttcttgccggacttgggctggatatagcacttctcctcctcgttccaccactcggaggaggcggcgtcgatggcgatcttgaagtcctcgccgggcttgtagccggcctcctcgatggccttgacgatgaccttcagggcgtcctcatccttcttcaggttgggggcgtagccgccctcgtcgcccacgccggcggcgggggtgccgttctccttcaggacgttcttcagggtgtggaacacctcggcgcacatgcgcagggcctcgcggaagcaacaggcgcccacaggcatgatcatgaactcctggatctccacgttgttggtggcgtgagcgccgccgttgagaatgttcatcatgggcacgggcagaatcttggcgttggcgccgccgatatagttgtacagggaggtgcccagggcctcggccgccgccttggcgcaggccagggaagcgcccagaatggcgttggcgcccagcttggtcttgttgggggtgccgtccagctcgatcagagccttgtcgatggcggtctgatccagcacattcatgcccaccaggcactcggcgatgtcggtgttcacgttcttcacggcggtgagcacgcccttgcccaggtaacggctcttgtcgccgtcgcggagctcgcaggcctcatagatgccggtggaggcgccggagggcacggcggcgcggccgacggtgccgtcctccaggtagacctccacctcaacggtgggattgccgcggctgtccaggatctcgcggcccagcacgtcaacgatctcaatgatctgcttcatgatgaaaactcctttcgtattggcggcgggagcctgctcccgcctacaggggtattttgtgtggggggcgggctccggcccgccggggctctatggtagggcgggggttcatccccgccggttaccgcttcgccgccattcccttaaacgggaaggtcagttgacaatcagcgtctccccatccatctcggcgggcttttccagataccccacgcggctcgccgcgcgggggccccgggtctttttatctgctcggggcaagtgaattgccccgacatcaaggttttggccgtcggccaaaacgcttggacggcgcacagcgccgcccgcctgcggcggggataggcctggaaaagcccttaattcaaaatcagagtctccccatccatctcggcgggcttttccaggcccatcagatccaacatggtgggggcgatgtcggccaggcggccgtcccgcagcttgacatcggcgcccacaatatagaagggcaccaggttagtggtgtgggcggtgtagggggtcgtaccgtcagcgtccagcatccgctcggcgttgccgtggtcggcggtaatgagcgacacgccgcccatccgggaggtggcctccaccaccttgcccacccccgcgtccacggcctccacggccttgacggcggcctcgaacacgccggtatggcccaccatgtcgcagttggcgaagttgaggatgatcacatcgtaattgccactctcaatgcgcttaacggcctcctcggtgacctcgggggcgctcatctccggctggagatcgtaggtggccaccttgggggaggggatcagacagcggtcctcgcccgggaacacctgctcggcgccgccgttgaagaagaaagtcacatgggcgtacttctccgtctcggcaatgcggagctgagtatagccctggcgggcgatatactcaccgaagatattggtcagctcccggtgggggaaggccaccagcacgttgggcatggtggcgtcatactcggtagtacacacataggtcaccgggaagtagccctttttccgctccacgtcggtgaaggcggggtccacaaagcagcgggtgatctcccgcgcccggtcggggcggaagttgataaagatgatggagtcgccctccttcaccttgccgtccttggtgcacaccacgggctccacgaactcatcggtcaccccggcatcataggacctctgtaccgcgtccaccgggtcgggattctgcacgccctcgccccgggtcatggcgtcgtaggcccgctgcacccggtcccagcgcttgtcccggtccatggcgtagtagcggcccatgacggtggccacctggcccacgcccacctctttgcacttttccaccagcttttccacatagcccttgccggaagcggggggcacgtcccggccgtccaggaagcagtggacatacacccggcctaatccccgctttttggccatctccagcagggcgaacaggtgggtgatgtggctgtgcacgccgccgtcggacagaagccccatcaggtggagtgcaccgtcccgctccttgcagtcgtccatggcctcgatataggcctcgttctcaaagaagctgccgtcctcaatggcgcggctgatgcggggcagatcctggaacaccacccggccggcgccgatgttggtgtgccccacctcggagttgcccatctggccctcgggaagacccacgtccagcccggaggcggacaggcggcagccggggttttccgcaaaaatcttgtccaggttcggcgtgcgggccgcggcgatggcgttgccagcccgctcgtcccatacgccgaagccatccataatgatcagggtagtcggtgtcttactcataataacctcgaatctcttcttctctttccaaaacggagacgggcgcgggcggccctgcgcttctcgctgtcacgctgcgggttgggcgcacgtccggatcgttaagtccgggctgcgcgaaaaataccgctccagggtatcgcccgtcgcctgttttttcgtctgcgccctgccttaactcccctgtacgcctgccctccgcgcttcttactcctgattggccgcgttcatgatctccacaaagtccggggccttcagagacgcgccgccgatcaggccgccgtcctcgtcgtcgcaaagtccgctccgctccatttccgcctcccggcgaacatttcactccgcttccttgctcctcctctcccaacgagacccgctgtatcgccgtcggcggctttgccgccttacaatacggcgtaccccttgcgggtgctgcgctgggctctcgttgggttcccgaaccgccgcccgacgcggacggcgttactcctggttggccgcgttcacgatctccacgaagtcgggggccttcaggctggcgccgccgatcagaccgccgtccacgtcgggctgggccagcagctcatgggcgttctttgcgttcatggagccgccgtactggatggtgacggagcgggccacgcgggcgccgtacagcttgcggatgacggtgcggatggcctcgcagacctcaccggcctgctcggcagtggcggtcttgccggtgccgatggcccagatgggctcataggcgataaccacatggcgcatcttctcggcgggtacgccggagagggcggccttcacctggtaggagatcagatccatggtgacgcccagctcccgctgctccaggctctcgcccacgcagacgatggggtacagccccgcctccagggcggcatgcaccttcttgttgacggtgaaatcggtctcattgtagtactggcggcgctcggagtggccgatcaccacatacttgacgcccagctccttgagcatctccggggagacctcgccggtgtaggcgccgtgggactcgtagtggcagttctccgcgccgatggagacgcggcactctttgaacaggcgcacggcggcctggatattcacatagggcacgcacagcactacctcgcaccagttgggcttgcccagcaggggcttaagctcctcggcaaatgcacgggtttcggagagggttttgttcattttccagtttccagcgataatcgtcttacggtagcggcggttcacggcaaacaatcctttcgattttggaatagctataagggggcggcgcggccccagcgcagcggttcgtgcggggccctcggcggaggagctgcccggcacggaagttgtcacgctgcggcggcggcgcggtcgccgcactgctcacccctccgcgaaaaacaccttgcgcctgcggcgcaactgctttttcgtctgcgggcttcgctgtgcggctgctccgctcgtctccgcgattctttcttacttatccagcaggcacgccacgccgggcagctccttgccctccaggaactcgagggaggcgccgccgccggtggagatgtgggtcattttgtcggcgtagcccagctgggccacggcggccgcggagtcaccgccgcccacaatggtgatggcgtcggtctcggccagggcctgggccacggcccgggtgccctcggcaaaggcggggaactcaaacacgcccatggggccgttccagataacggtgccggcctctttcacggccgcggcatacagggcgatggtcttgggcccgatgtccatacccatcatgccgtcggggatacccgcgccgtccacggccaccggcttggcatcggcggaaaactccgcggcggccacgccgtccacgggcaggagcaacttgacgcccttgtccttggccttctgcatcatctcccggcagtagtccagccagtcggcctccagcagggagttgcccacgccgatgccctgggccttggcaaaggtatagcacatgccgccgccgatgatgatggtgtcggcaatgtccagcaggtgattgatcacgccgatcttggaggacaccttggagccgcccaggatcgccaccagggggcgcttggggttagccagggcgccgcccatgatctccagctccttctggatcaggaagccggacacggcgggcaggtaggctgccacgccggcggtggaggcgtgggcgcggtgcacggcgccgaaggcgtcggacacgtacacgtcggccatggccgccattttcctggccagctcggggtcgttcttggtctcgcccttctcaaagcgggtgttctccagcagcaggatctggccgggcttcaggacggcggccttggcggtggcatcggggcccaccacgtcggcagccatgatgacctcgcggcccaacagctcgctcaggcgcttggccacgggagccaggctgaacttgggatcgggtccctccttgggtttgcccaggtgggagcaggcgatcaccgccgcgttctgctccagcaggtactggatggtgggcagggcggccacgatgcgcttgtcgtcggtgatggcgccggtggccttgtcctggggcacattgaagtcgcagcgcagcaggaccttcttgcccgctacgtcgatatcctttacggtcttcttgttgtagttcatagagcctctcctttcatcgcgccctccccggtcaggccggggaagtcaagctgccgcagcgcctcataggtcagaatggccgcggcgttggataagttcaggcaccgggcctccgcccggattgggatgcggatgcagcggtcggcgtgagctctgcggaatgcctcgggcaggccggcggtctcctttccgaaaaccaggtagcactcgtcccggaaaaccgcctcagtataggatctgggcgccttggtggtagccagccagatatcctccgcgccggtcttctgaaagaagtcgtccaggttttcatatacccgcacgtccaccagatgccagtagtccaggccggcccgcttgaccgccttgtcgctgatgtcaaagcccaggggcttgatgagatgcagccgggtcccggtcaccgcgcatgtgcgcgcgatattccccgtattttgggggatctctggctcaaacagcacgatattgagcaccctgtctccccctcccggttactacttggtcagcgcaggctattgtactccaaaacagcaaggatttcaaccttaaatgtgtaaatacgcgctaaaacattcagttttctttctggaagcagccccttccttttctttttattgcccctttcgtgcgccggtgaaatgtgctatgatgaagggcgaatggaagaggagtgtgaagcacgtgaaacaaccgcgcaatccgcgcaggctggtggtcaaggtgggcacatccaccctcacccgggagaccgggagcctcaacctgcaaaacatggagcatctggcccgtgtattggccgatctggagggcatggggtatcagcccgtcctggtgtcctccggcgccatcggcatcggcaccaaaaagctgcggctgggggagcgccccaccgagctgcggatgaagcaggccgccgccgccgtgggccagtgcaggatgatgcacatctatgacaagctctttgccgagtacaaccggacggtggcccaaatcctcctcaccggcgaggacgtggagtcccccgtccgctcggagcatctgcacaacacctttgaggccctgctggagctgggggtgatcccggtggtcaatgagaacgactcggtgtcgtcagcggagatcgaaaccggccagtgcaaggtgctgggcgacaacgacaccctgtccgccatcgtggcccggctgtgcggcgcgggcctgctggtgctgttcagcgacatcgacggactgtatgacgccgacccccgcacccaccccgacgcccggctgatccaccaggtggaggccatcaccccggagctgcgggccatggccggcggtgcgggcacctggcgcggcaccggcggcatggccaccaagctcaacgccgcccagctctgcctggaggcgggggtggacatggtcatcgccaacggggcgcggatggaggccctctacgacatcgtggaggggaagaacgtgggcacccgcttttctgcccggcggggcgcgctgcaatagaaaagaaggaggaatcccatgactgtactggagacccagggtctggcggcccggcacgcagcccgggcgctggccgtggcgggtaccgccaggaaaaacgccgctctggaggcggccgccagagccatcgaggcccggcagggggagatcctggcggccaacgccgcagatctggaggcggccagggccgccggactccgccccgccctgctggaccggctggcgctggacgagggccgcatcgccggcattgtggagggggtgcggcaggtggccgccctccccgatcccatcggagcggtgaccaaaatggacacccggcccaatggactgaccatcggaaagcgccgggtgcccctgggggtgatcggcatcatctacgaggcccggcccaacgtgacggtggacgccgcagccctctgcctcaagtcgggcaacgcggcgctcctccggggcggcaaggaggccttccgctccaaccaggcctttgcggccgtcctgcgggacgccctggaggaggccggcctgccccgggactgcgtggccctggtggccgataccagccgggagagcgccaacgagctgatgggcctgacggagtacctggacgtgctcatcccccggggcggggcggggctgatccgcagcgtggtggagaacgcccgggtgccggtcatccagaccggcgtgggggtgtgccacatctacgtccacgagagggccgacctggacatggcagcccgcatcctctacaacgccaagacctcccgcccctcggtgtgcaacgccgccgagtgcgtgctggtggaccgggcagcggcgcgggacttcctgcccctggcgtgggagctgctccaaaccaagggcgtggagctgaggggctgcccggaaacccgggccatcctgggggactgggtcaagcccgccgctgaggccgactgggacaccgagttcggcgactacatcctggccgtcaaggtggtatccggctttgacgaggcggtggacttcatcgcctcccacggcaccggccactccgaggccatcgtcaccgccgactacttcgccgcccagcgcttcctggacgaggtggacgccgcggcggtgtacgtcaacgcctccacccgcttcaccgacggcttcgagttcggcctgggggcggagatcggcatctccacccaaaaaatgcatgcccggggccccatgggcctggaggagctgaccagctccaaatatgtaatctacggcaccggacaggtccggtgagcataggattctagggggccgcccggccctccgcgcggcatagccgctgcggtttcgcctgcgccccgcgcctccgcgcttcttgtcacgctgcggcggctgcgcgacggtgtctaagcccctccggctgtgcaagccggcctgcggccccttcgggccctccggtccgttcgctccgctttgggtcttacccgcctgcgccccgcgcctccgcgcttcttggtacatacggctgccatgccgtatgaaggaggtgctgaccatgttggaataccggctggagccggagggcgggctcctcgtctgtgcgctgggcactctggaggtggggggcggtcagattgtggagtgctccctgtgcctgtcggatatcctgcccgagcggcgggtggccctggcggtggagcttctggagggcgaacagctccggggcacgcggctctataccgtgccgccccaccatgaggacggccccgccgacgtgcggatagagggcatccgcttctacctgcccggcggcgcgggaccggaggggctgactctccgggccgacgcccactatatcgaccggggtgaccgctgcgtgttgccctgacccctttgagggcccctttggggccctcaaaatttatgcttgcatctttcgccttctttccctataatgtcactcactgcgcaatgcgcagaatcggacattgaaggagatcgagaaatgaaacaacaagtcactctggcgctgagcctcaccctggcggccggccttctggccggctgtgccgacacgacgggcgggagccagccgactggggcggcccaaacatcccctgcggatgccacaccgagcgcggcgcagagcgccgcctttaccgacgagatgaagatcccccatgccgtggatctctcccccgaggacggcgccgactccgtggagcggctgggcgaccacgcggactccccctactttgcccaccccgactactaccacatgcagtccagcgacaccctcacgatcctgaccggcttccagaccatgcagcagaccagcgaatgggcctgcggcgtcaccagcaccctgatggtgctcaactggtatgaccggctgggcgactggaacgaggagagcctggccgccctgcgccactccctggagggcaccgggctggccggctaccccggcaccaccctgcggcaggccatggatatctttgacggcgtgggcggatttacctataccaccaacctggactacgaggacccctcctccgaggtctggatggacaccatccagggctggctggccgagggcaagccggtcatggtctgctggaacgactggggcggacactggcaggtgatcatcggctacgacaccatgggcaccgagacccagcaggacgacgtgttcatcgtggccgacccctacgacaccaccgaccactgtcaggacggctacggcgtgctgatggcggagcgcttcctgtataacttctccatgtacggcgctttcccggaggaggagggcggcagcgacttcctcttcctggtggcctcccctgcggaataaaccagaaaatcccgtgcggcacacaccgcacgggatttttttagaactggaagaccgcgccgatcaccgccgaggcggcgatgaacacgatggggtggagttttttcaggggcttcacctggaggcacacgaagatgaccaccgccagggcgatccccttccactggaacagggccgccgcgccgccggtctggaaggcgctcaggttcagcagggcgatggagcaaacctccgccagcgccgcggcgataagggcggtggaggcggggcggatgccgtagaacaccgcgtccaccccccggctctcccggaacttcttcaaaaagcccgcgatgaccaggatgacgaggatggaggggcacaccaggcccagggtggcgataacgccccccgcgatgccgccggtgtggaagcccacgtaggtggccatgttcacccccatggggccgggggtggactcggagatggcgatcatgttggccagctctccggaggtgaaccagccggtgcgctgcccgatgtcggtaaggaagggaatggtggccaggccgccgccgatggcgaacagccccgccttgaaaaactcaaagaagagctgaaggtagatcacggccgcagccctcctctcgccgcccggatgcacagtccggccacgccggcggccaccaccagcaccacgggggaacagagaaagctgagcacgctccccgcccacccggctgggaaggacacaaagctgccgagcaccgccagcaccagcaccaccgcgaagacgcccgccgtcggcccgtccaccaccgtgctcttgcgcagcttgagcacgctggacaggatcagggcgcacacacaggcccgcacgccgttgaaggcgtgcaccaccacgggctgctcggcaaagttctggaggaaggcggcgatgagcatgatgatgaccaggcaggggaacaccagtcccagggtggccaccacgccccccgccgctcccttccggctgtgccccacaaatgtggcggtgttgacggcgatgatgccgggggtacactggccgatggcgaagtagtcggagagctcctcctccgtggcccagccccgcttctccaccagctcccgctggaggatgggcagcatggcatatcccccgccgaaggtgcaaaccccgattttggcaaaggtcaaaaacaggtcggcatagatgttcacgtcactccagcccctccagctcctccagccacagggccgccacggcgtcggagggcatgcgccagtcgcccctgggagagaggctgaccgagcccaccttgggtccgtcaggcaggcaggagcgcttgaactgctgggcgaagaagcggcggtagaaggtacgcagccactggagcacgacggcccgggggtaggtgcggccgaaggcgtgctcagccagccggagcaccttccgtggcgggaaggcccagcggatggcatagtagaggaagaagtcgtgtagctcgtaggggcccaccagatcctcggtcttctgggcgatctgcccctcgatggcgggcaggagttcgggggaaacgggggtgtccaggatatcactgagcacatgggagagggcctcgtcctcctccgccttgtccccggccacataggacaccagacggcgcaccagggtcttggggatggaggcattgacactgtacatgctcatgtggtcgccgttgtaggtggcccagcccagggccagctcagagaggtctccggtacccaccaccagtccgccgcactggttggccacgtccatgagcacctgggtgcgctcccgggcctggctgttctcaaaggtcacatcgtggtcgtccatggactggccaatgtccttgaagtgctgtcgaaccgccgcgccgatgtcgatgcgcctgagggtggcccccagccgctcggccagctccacggcgttgtcccgggtgcgctcggtggtgccgaagcagggcatggtaacggcaatcatgtcgctggccggccggtccatcaggcgcatggccacgctggtgatgaggatggccagggtggagtccagcccgccggacaggcccaccaccgccgcctgtgcgccgctgtgctccatgcgctttttgaggcccagcgccgccaggaggatgatctcgtcgcagtgttcgctgcactcggcgccgtcctccgggacgaagggcagggggttgacatggcgggtgagggtggtggtgcacggctccagggcgaaggggacggtgatcacccggctgtccgcattggagcggaaggtggtcaggcggcggcgctcgtagtccagccgctccacgtccacctcggacacggtgagcccggtggcgaagcggcgctcggccagcagggcgccgttctcggccacgatgttgtggccgttgaagaccaagtcggtggtggactccccctccccggcgttggcgtagacatagccgcacaccagccgggcggactggccgcacaccaggcggcggcggtactcggccttgcccaccagctcgtcggaggcggacaggttgaggataacggtggcccccgcctcggccagggccacagaggggggcgtggaggcccacagatcctcacagatctccacccccacagtgaggccgggcatgctctcgcaggggaagatcacgtcggagcccagatagacctcctgcccgcagaaggagaatagacggtcgccggggccggcaggctcaaaccagcgcttctcgtagaactccccgtagttgggcaggtaggtcttgggtaccagggccagaatctccccccggtggagcacggcggcgcagttgtagagcttgttctggtgccgcacgggcagccccacggcggccaggagatccaggtgcttggtggcctccaggatggtggccagcccctcctccgcgccacggagcagggtgtcctgaaggaagaggtcgccgcaggtgtagccggtgaggcacagctcgggcagggccagcacccgcaccccctgcttatcggcctcccgcatgagggtgaaaatctgttcggcgttgtagcggcagtcggccacccggatctggggcgtgccggcggccaccttgatgaatccatcgcgcatagaaaggcgcctccttatggcgtatcatggtctgtgcctttatgataccccaaaccgcagtggattgcaacgcccgccccggggatttaccccagcttgcgggcgaagtcggccagagcttcggagattttgagctgctgggggcacactgcctcgcagctccggcagccgatgcaggcggcgggccgcttctcctccggcagggcttccaccgccatgggggcgataaagccgccgccggtgaaggtgtgctcgttgtagagggccagcaggccggggatgtccaggtgccgggggcagtggtccacgcagtagcggcaggcggtgcagggaagcacctgctcccgcaccatgccggcggccacgtccagcagggcggccttttcggcctcactcagaggccggtcggtttcgaaggtgtccaggttggcccgcagctgctccaggctggacatgccggagagcaccatagtcacgccgggcaccccctggaggaagcggaaggcccagcccggcatgctctcctccggccgcaggacggccaggcgggcggcgtccccgtcggacagcctggccagccgcccgccccgcaggggctccatcacccagatggggatatggcggcggttcagctcctccgccttggccctggcgccctggaagtcccagtccaggtagttgagctggagctggccgaactccatgtattccccataggcgtccaggaagcgctggatcaccgccagggagccgtgggcggagaagcccaggtgccggatgcgcccggcctccttctggcggagcaggtactccagcacgcggttgtccgggtccagataggggcccacgttgcgctcgtatacgttgtgaaagaggtagaagtcgaagtagtccacgccgcacttctccagctgctcctcgaagatggcctccaccctgtccggccggatgttggacacgtcgtagccggggaatttggaggccaggagccagctctcccgcggataacgggacagcacgcggcccatcacccgctcggaattgccgttgtgatagccataggccgtgtcaaagtagttggccccccgctccatggccagggccaccatctcggccaccgccgcctcgtccacgtcgccgtccccaccgccgggcagcagaggcagccgcatgctgccgaagcccagcatgggcaggcgcaggttttgaaagtccttgtagatcacggaatgtcactcccatacattgatttcaatttaccttactccctggagtacactccaagtcaagccttttttccaaaaacaccgaaaagccccggccaaaggccggggcttttcgggtgtgtgttgtgtgtcttgcaaaggtgttggagagggataagagaggaattggtttgggaggatggtctcattcgattcatctctgaatctgtctgtatcataccgtgtaaataagactaaatcgtgtctttaatgtgaataaactgtaaatatcagttttttatgtattggaggcgggatgtcacccggtcagatcggcgggcggggacaagccccgcccatacagtgccgcgtatcatgcggaactcgatatgcccccaaccaggcaggggcggcccttggggcctcccgcgggcggggacaagccccgcccctacagcgccgcgtatcatgcggaactcgatatgcccccaaccaggtaggggcggccctcgtggccgcctgcgggcggggacaagccccgcccctacagcgccgcgtatcacgcggaacccgatataccccaactaggtaggggcggccctcgtggccgcccgcgggcggggacaagccccgcccctacaatgccgcgtatcacgcggaacccgatataacctccagccaggtaggggcggccctcgtggccgcccgcgctccgggataaagtggactcttgactttccttcccctcagtgatatagtaggtccgttcaaattggctttgacggagacgaacccgcacagcggcggacagagaggggcgcgcacggtggaagcgccccacgacacgcggcggctgtaccactcccgagccgcccgggatgaccgggccggggctttcccgttacaggaagtcacaagcggccagttgccacgctgcacgccctctgcggcggccagctgttccacgctgtgccgaacctgccgccgggctttgcccgaccgttcgttcggcctgcgcgtgttgcggttgtcctgccgggcgtctctgtgtctctggcaagcagggtggaaccgtgggacgtatgacagcgcctcacccctgacacactcaggggtgaggcgttttttgctgtaaccccgccgcatttttaccggggcgggcgccgtgtgccgccccacagacgagaaggaggttatcagaatgtccgaagagaacaagaacagtgaattttcctttgaaaacgagagctaccgcaagacctactggcacacctgctcccacattctggcccaggcggtgaagcgcctgtacccggaggtaaagctggccatcggcccctccatcgacgagggcttttactacgacatggactcccccttccccttcactccggagatcctggagaagcttgagggagagatgcgcaagatctgcaaggagaagctgaagctggagcgctttgagctgccccgggaagaggccctcaagttcatggaggagaagggcgagccctacaaggtggagctgatccatgatctgccggaggacgcccacatctccttctacaagcagggcgagttcaccgatctgtgcgccggcccccatctggactccaccggccgggtcaagggcaacgccatcaagctgaccgcctgcaacgccgcctactggcggggcgactccagccgccagaccctccagcgcatctacggcatcgccttccccaagaaggacgagctggacgcctacctccagcgcattgaggaggccaagaagcgggatcaccgcaggctggggaaggagctgggcctgttcaccattatggacgagggccccggcttccccttcttccttcccaagggcatggtgctgaagaacaccctcatcgactactggcggcaggtgcacaagcgctacggctatgtggagatctccacccccatcatgctcaaccgctccctgtgggagcgctccggccactgggaccactacaagaacaacatgtacaccaccgtcatcgacgaggaggacttcgccgtcaagcccatgaactgtcccggcggcatgctggtctacaagaacgagccccactcctaccgggatctccccctgcgggtgggcgagctgggcctggtgcaccggcatgagctgtccggcgccctccacggcctgttccgggtgcgctgcttcacccaggacgacgcccacatctttatgacccccgaccagctcaaggacgagatcaagaacgtggtcaagctctttgacgaggtgtactccgtctttggcctgcactatgagatcgagctgtccaccatgccggaggatcacatcggcaccgtggagcagtgggagcacaaccaggacatcctgaaagaggccatcaccgagatgggcaagacctacgtgatcaacgagggcgacggcgccttttacggccccaagctggacttccacctggccgactccctgggccgcacctggcagtgcggcaccatccagctcgactcccagctccctgagcgctttgagctggagtacgtgggcgcggacaacgagaagcaccgccccatcatgatccaccgggtggtgctgggctccatcgagcggttcatcggcgtcatcaccgagcacttcgccggcgccttccccacctggctggccccggtgcaggtcaaggtgctccccatcaccgaccgggcggcggagtacgccgaccaggtggccgccaggctggacgcgctgggctaccgggtggagaccgaccaccgcagcgagaagatcggcttcaagatccgccaggcccagttggagaaggtgccctatatgctggtggtgggcgacaaggaggccgagaccggcggcgtggccgtgcgcaaccgccacggcgggcagaccgtcatgagcttcgacgcctttgccgccaagctcagggacgaggtggactccaaggccctggagcagaactgaccttcccccgattttgatacgccctgggcggccataggccgcccagggcgtatctgttcttacgggtcgtttcccctccctgccccgtaggtctctttttgcggacaggcctttccatagacccccaatttctcaagaatgcacagcggcggcccgcgcatccacgcaagccgccgctattcctttgccttcatcgcgtccaccagccgggccagcgcctccgcctcccgctccgtcagcccgtcggtgtgaatcgccggagcactctcccgctccgggaacaccagcgcatccaccgagaagtccagcagctccatcatctgaaagagtaatggaacggacggcaaccgacgggatccttctatattttttaggtggatcggcgtaatgtccagcatttcagccagacactcctgtgttagcccttttttcatgcgggcggtgcgaatggtctctcccagcgccctgcgatccagttccatcctcatatctaacagcaccccttttaggtatcttaaagttaatattctctattgcaaatttcctaaaagattattataatagatgctataagatacccctcactaaaatgaactgcgattactggggtgattatatgtgggaagtcgtagcttttgtcattatcatagttatcggaattttctatctcataggtacttattttggcgctggtgccgttattttagtaatcggcgctattgtatttggattttataaatttcttcattttggtgatacagcagaagaagaatccgaatatgtagaaaacgctctcaagtttatagaatttacgaaaagattaaattcccctctgcttacgttatttgccactcccaaacatattggagtcgttttatctgatgatgctttgggtatatgtgtgcaaatgtgtttggctacaacctcagatgcgaggttagaaaaagccaggcgtgatctattggaaaaagagctggtaaagcatattgatggtaataatggattgcaattatacagagagctatgcttagatgtcgacttgtggaagcatgatgaagatcatccgattatattaaaatatcttctgccgccgtataatagagcccggagcgaattacaacaattagatacatatataaatgcactcaagcgccgatacaaaaagcaataccaaaaagaactaaagattgttacttggattgattataaataaaacgagaggtgaacacgatgccatccagcgactacaacaagtacctcgccgccatcaaggcggccaacgacatggagaacaaagagcttttgcggcagatcaaaaacgagcttatcgccaattacggcctcatggacgacgacgtggactatctgctccggcagttccgctacaacgtctgactgacagaggggtgccccggccgcaggccggggcaccccttttgtgtggactttacgggcggcccatgctacaatagaattcggtacttcattaagagacaaaggatggatgggaatgggaacgaccctcagtaccctgagcaatctggcaatctacatcggcctggtggtggtgggcgcctttctgggctcccgcaaggcactgcgcagccgtcccctggcgtgggtgggcaagctccagttcgcggccctcatgatcctcattgtcaccctgggcatcaacctgggcgccaatgacgaggtggtctcctccctggggcagatcggcctggcggccctggtgatcacagtgctggccatggccggctccctgctgtgcctcaccctgctgcggcggttcgtgctcaagctggaccactacggcctgccccggggcagcgaggccgcccgggaggaggaggcccaccacggcggcaaggcggacaactccctcaccttcctcattgtcattgccgtagtgctggggatgctggcgggccgcttcgtgctccccgccgccgttaccgcccactgcggcacggtcatcagcttcggcctctacctgctcctctttatggtgggcatggacatgggcaagcagggcaccctgctggccgacatcaagaccgccggcttccaggtgctgctggtgccagtggcggtgtgcgcgggctccctggccttcgccgccctggccggcctcttcctcccactgggggtgaaggactccatggccgccgcctccggcctgggctggtactccctggcccccaccctgctggccccctactccctgtcggtgtccgccgtggccttcctgtccaacgtgatgcgggagatcttcgccatcatcaccatccccattgtggccaaatacgtgggctatgtggagtgcgcctccctgcccggcgcggcggccatggacacggtgctccccgtggtggtgggcgccacccacgagcgcatcaccatctactcctttacctccggcgtggtgctatccctggcggtgcccctgctggtgcccgccatcgtggccctgcccttctgagaggaggtcttctgcatggaaattgaacgccgctggctggtggagggctggcccgccctgaccccctcctccgtccttcgaatggatcagggctactttgccgtccgccccgccatccgcatccgccgggaggccgtcctgggcggggagacccgttacgtcctctgcttcaaggggggcgcgggcctggcccgggaggaggtggaggtggacgtggacgaggggcgctacctccgcctcaaggccatgctgtccggccccatgattgagaaggagcagcgccgctattccctccccggcggcctcacgctggaggtcaaccaagtcgatcccgccctggagagcggcttctactacgccgaggtggagtttgacaccgaggccgccgccctggcctggacgccgccggaggcactgacggcctacctctcccacgaggtcactggccagcccggcgagagcatggcggcctactgggcccgcacccgaggctgaaaaaactcccccgcaggcatggcctgcgggggagtttcggttattttctgttgtccgtctcctccgggagcacctccacccggatctccagcacccggcggtggtccaccttggtcaccgtcacgtccaggccgtcggagacgaagcggtcgccctcctcaggcacacggccgatctgctccatcacccagccggagatggtgttggagtcgcactccccctttatcttgaacaggtcaaagaggtcggtcagatcggcggagcaggagatcaggtagctgccgtcctcctgcttcttgaactcctcgatgacctcgtcgtgctcgtcccagatctcgcccaccagctcctccacgatatcctccagggtgaccaggccctcggtgccgccgtactcgtccaccacaatgaccatgtgggctttctcccgctggaggatgcgcagcagctcggagatcttggtgttgccggtggtatagagcatggggcccagcatctccttcacgctggtcaggccgcggtagcgggccgcgtggaaatccttctcatggatgacgccgatgatgttgtcgatgtcctcgtggtacaccggcaggcgggaatacccgttctcagcgaagatcttggcgatctcctccatggagtcggtgtcctccaccgccacgatgtccaccctgggggtgaggatctcctccacctccaggtcgtggaactcgatggccgcccggataaggcggctctcatgctggtccaggccgccctcgctctccgcctggtccaccagagtgaccagctcctcctcggtaatgccgccgtccgccgatttgcggaacaccttggacagcagccgcttccactgggtaaacaggaagttcagcggggtaaggaccgtacggagcacccccagcagcggggtggcaaacatggcaaaccgctcgggggactccttggccaggctcttgggggagacctcgccgaagatcaggatcaccacggtcagcacaatggcggacacggtaggtccagtcacctcatcaatcaggtggataaagagtaccgcgccgatggtggtggccacgttgttgacgatgttattgccgataagcagggtggagagcagcttgtcgtagtcctccgccagagccagggtacgggccgcccgctggtcgcctccgtctgcccagctcttgagccgcacccggttcagggaggtaaaggcggtctccgtggcagagaaatagcctgacatgataacacagaacacaagacccacgatcatggcgatactggcactgtccaacataagaaaatattcaactccaactctttcagttttgaaatcaacgcgcaaagggacaaccctatcccccgcgggtaaggctgtccctgaccgattccattatgtacttgcaactaggcggaggttcgtccacgagggctcaccgtctcctttttggtttattggtgtgtagtatagcacagcttcctgcaaaatgcaaggggaaggttgacttttcctgtcccgccccccataagcgaaaaaacgcgcccagcctgcggctgggcgcgtttttgatgctcttttacgggtgattacaccagctggacgatggccatctcggcgcagtcgccgcggcggggcccgatcttcacgacgcgggtgtagccgccgttgcgggtggcgtacttggggccgatctcgtcaaacagcttcttggccacatcctccttggtcaggtaggacagagccttgcggtagttggccagattggcgttcttggccagggtgatcatcttctcggccatgggagccacttccttggcgcgggagacggtggtcttgatctggccgttctccagcagataggtggtcatggcgcgcagcatcgcgatgcgctgatccgtgggcttgccaagcttacggttgtgagacatgagattccactcctaacggatgttcgccaaggcgaactcctactcttaaattcgtccgtggggagattcccccgaaagggcgctccatgggagccggccggacccgggaggggacgttacgtgcccccgggccgccctttcctccggccgtcagttttcctcgtcggccaggtgcaggcccatcatggccagcttgttgatgacctcttccaggctcttgcggcccaggttgcgcaccttcatcatctcgtcctcggtcttggagatcaagtcctcgacggtgttgatgttggcccgcttgaggcagttgaaggagcggacagacagatccagctcctcgatggtcagctccagcaccttgtcccgctgggtctccgccttctccaccaccgtggacttggagcccatggtctcagagagatcggtgaagaggacgaagtgatcacagaggatgcgggcgcccaggctgaccgcgtcccgggcggtgatggtcccgtcggtccacacctccagggtcagcttgtcgtagtcggtggcgtcgcctacacgggtgttctccaccgtgtagttgaccttgcgcaccggggtatagatggagtccaccgggatcaggccgatgatggtctgggccggcttgttccggtcggcaggcacatagccgcggccgtgggacagggtcagctccatgttgaggctggcgtcgggacccagggtggcgatgtgcagctccgggttgagcacctccacctcgccgtcggccttgatgtcgccggcggtgacctcgcactcgccgctggcctcaatatagaccgtctttacgccctcggagtgtagctttgcgatgatgctctttacattgaggacgatctcggtcacgtcctcctttacgccggggatggtggagaactcatgctgcacgcctgcgatcttgatggacgtgaccgccgtaccgggcagggacgagagcaggatgcggcgcagggaattacccaacgtggtgccgtaaccgcgctccaggggctccaccacatacttgccgtaggaaccgtcgccggggttctccacacattcaatgcggggcttctcgatttctaccatgtgttaccctccttttcgcggctgcgggcacaaggcccgcagccctatacagctcaccaataatcgagggtacaagcagtgttacttggagtacagctcgacgatcaggtgctcctcgacgggcagatcgatgtcctcgcgggcgggcatctgcaccacggtgcccttcagcgcgttcttgtcccgctccagccacttgggcaccagaacagtgggggcgtccccaccggtcaggcgcttgaacttgacggaggagcggctggactccttgacctcaatcacgtcgcccgccttgaccaggtaggaggggatatccacccgctggccgttgacggtgaagtggccgtggcccaccagctgacgggcctcacggcgggtcatggcgaagcccagacggtacaccacgttgtccagacggcgctccacgaaggtcagcagattctcaccggtcttgccgggcatacgggcggccttctcatagtacatccggaactgcttctccatgatgccgtagacgaacttgaccttctgcttctcggtcaactggagggcatactcgctcttcttctttctcatctggccgccgggattgcggttgctctccttcttggcatagcccatggcggcaggagaaatgcccagcgcacggcagcgcttggcgataggctgcatattctttgccatttgttcttcctccttctcttacacgcggcggcgcttcggcggacggcagccgttgtgggggatgggagtcacgtccttgatcagagtgacctccaggcccacggcctgcagggcgcggatagcggcctcacggccggcgccggggcccttcacgtacacctcgacggtcttcaggccgtgctccatggcggccttggcggccgtctcggcggccgtctgcgcggcgaagggggtggacttacgggaaccgcggaagcccaggccgccggaggaggcccaggacagggcgttgccgcccatatcggtcacggtgaccatggtgttgttgaaggaggaacggatatgcacctggcccttctcaacgttcttgcgctcgcggcgcttgcggataaccttcttacccttggtagcggtagccatgtgtttctccctcccttacttcttcttgttggcgacggtgcgcttggggcccttgcgggtgcgcgcgttggtcttggagcgctgaccgcggacgggcaggcccttgcggtgccgcatgccgcggtagcagccgatctcggtcaggcgcttgatgtccatcgccacgtcacggcggaggtcgccctccacagtgtagctgtggccgatgatctcgcgcagcttggcctcatcttcctcggtcagatccttcacgcgggtgtcggggttgattccggcctcggccaggatcttgttggcgctggtgcgcccaatgccgtagatataggtcaggccgatctctacccgcttatccttcggcaagtcaatgccagcaatacgtgccatactgtttcagcacctcctattaaccttgtctctgcttgtgcttgggattctcacaaataaccatgaccttgcccttgcgcttaatgatcttgcacttctcgcacatgggcttcacggacggtcttactttcatgataaacctccttgaatgccttgatggccccggaacggcggaggcaaggccccgcttacccgctccggtcattgatgggttctcccagggggaggcggcgcaattccatttcgccgcgttaaatcagccggttacttggatctccaggtaatcggccccaggttacgtcatagggggacatctggaccgtacgccccacccggcgcaggcgccgtgtggggaccccgactccatctgcgggcgtcggaagtgaattccgccgccctccgcgccagaggcgcgccccgcactgcggggccccagtgacggtccggccagcctgacagattacttggaccgccaggtgatccggccccgggttacgtcatagggggacatctggaccgtcactttatcgccgggcaggatgcggatgaagttcatgcgcagcttgccggagatgtgggccagaataatatggccgtttccgatgtccacatggaacgtggtgttgggaagggactcggtcacgacgccctccacttcgatcatatcgtcctttgccaaagcgtcataccctccttagttcctcagctcggaaagcggccagcgccctccgtatgtctcggttggataggttcccgcctgtccggagctgatccaggacagggtgctggaaatcaccggcgggggcggtatgaaccgcctttttccgcttggggttctccagcttccgccgcttcccgtcgcagagcagcaggtaggggccgtcggtgtccaggacacagaacagccctcccctgtcatgcccggccagggagcggacaatctgcgcacacgcgcatcccatactcaatcctccacccgggtaagcacttcaggctccccgtcggtgatgagaatggtgttttcatagtgggcggtcaggctcccatcggcggacacggtggtccagccgtccctgagcaccttcacccgccagtcacccgcgcacaccatgggctccacggcgatggtcataccgggctggagccgggggccatggcccgctgggccaaagttgggtacctcaggcggctcgtggagtttggcccccacaccgtggcccacgaagtcccgcacgacggagcagccgtctgcttccacgtactgctgcaccgcgtgggagatatcatagacccggttgccggagcgggcgagcttgatgccctcccagaagctctgttcggtcacatggatcagatgcatggcctcgtcgctcacctgtccgcaggcgaaggtggcggcgcagtcgccgtggaagccgtccagaaaggcgcccacgtccacgctgacgatgtcgccctccttcagcttccggggaccgggtatgccatggatgacttcctcgttgatcgagatacaggcggagccggggaaaccgctgtagcccaggaaggagggcttggctccgtggctctcgataaacttgcgcacggcggtatcgatctcatgggtggtcacgccgggccgcaccatggagccggccagcgcccgggcctgggcggtcagccgcccggcccggcgcatgcactcgatttcgcggggagatttgagagagatcatatccatctcgttcacttccccagcaattccatgattttggtgtttgtctcctcgatgccgcccaggtcgggcacgcgcttaagcacgcccttctcctcgtagaagcctttcagcggctcggtttgactgtggtagatttccagccggtgcttgacggtttcgggctggtcgtctttgcgctgctccagcacaccgccgcacttgtcgcagagcccctcctgcttggggggcgccatgacgacgtggtaggtggctccgcaggcatggcaggtccggcggcccgtcatgcgggcctcgatgacgctgtcggccacctccagggagaggaccgcgtcaaagcggatgccgtggcgctccagggcttcggcctgagcgatggtacggggtacgccgtccaggatgaagccgcctgcgcagtcgggctcggccagccgctcctggatgataccgatgatgatctcatccggaaccagcttgcccgcgtccatatagctcttggcctgcaagccgatgggagtgccctccttgacggctgcgcgcaggatattgccggtggagatggtggggatgcccagcttgcggctgataatctccgactgggtgcccttgccggcgccaggtgcgcctaaaagaatgattttcatcctgattccccttactccaggaagcccttgtagtggcgcatcagcatttgggcctccagggccttggtggtctccagcgcgacgccgaccacgatgatgatggacgtgccgccgatggccaggctgctgacgccgatcaccgcgccggtgacaatgggcgcgatggcgataatcgccaggtagagcgcaccgaacatggtgatcttattgagcaccttgtggataaagtcggcggtgggcttgccggggcggaagccggggatgaacccgccgttctttttcaggttgttggcaacctccacagggttgaactgcatcgtggagtagaagaagctgaagcccacgatgagcaggaaatacaccacgatatagaaaatgctggtggtgtcaaagacgcgcaggaagccgccccagaagcccgggtcgttcttgctcacgccggcaaacgcggcgatggtagcgggcagagaggcgatggcctgggcaaagatgatgggcataacgccggtcatgttcaccttcagagggatgtggctggactggccgccgtacatcttccggcccacaacgcgcttggcgtactggacgggaatgcggcgctccgcattctgaatgaatacaatgagaaccacgatggccagcatgccgatgagaatcagcgggatggcccacacgggcagattaaagattccctcgccggtaacgccgtccagattgttgcggacgccctgatacatggtgcggatcatgctggggccgcgggacaggatgcccgcgaacaggatgatggagatgccgttgccgatgccgaactcggtgatctgctcacccagccacatgacaaaggcggagccggcagtgaagcacagtacgatgacgatacccgcccaccagccaggcaggccggcggtgtccagcatcgttccgccgccctgggtgcggatcagggtgtagtagccgaagccctgcagcaagccgatggccacggtgacatagcgggtaatggccgcaatcttcttccggccctcctcgccgccctccttctggagccgctccagggcagggatggcaacggtgaggagctggatgataatagaactgttgatatacggctgcacgcccagggcaaagacggccgccatggagaaggcggtgccgttcatggcgcccagcagggtgaagatgccgcccatgttgttgagggtggcgcccagcatattgctatcaataaaggggacaggaaccacggagcccagccggaagatcagcagggcaaacacggtgaagaggatcttcttccgcagctcgggaattttccaggcgttacggatggtctcgatcacttagaccacctcgtactttccacctgccgcaacaatcttctccttggcggaggcggagaaggcggaggcacggaccgtcagcttcttggtcagggtgccgttgcccagcaccttgtagccgtactcgcacttggagaggatgcccttctccagcaggtcgcacacattgaccgtagcgccatcctcaaacttctcgagggcggagacgttgatcgcctccaggggtttggcaaagatattgtggaagccgcgcttggggatgcggcgggtcagaggcatctggccgccctcaaagcccacgcgcacgccgccgccggagcgggcccactggcccttctggccgcggccggccgtcttgccgttgccggagccgtgaccgcggcccttccgataggccttggggttggaaccgggagcgggggaaagttcatgcagattcatttcgcgcacctccttactgttcctcggtgacctggagcaggtagccgatgttcgcaatcttgccgcgggtcgcctcgttgtcgggctgcacggtggtgtcgccgatcttgcgcaggcccagggcctcggcggtcgccttgtgcttggcgatacggccgttcaggctcttgaccagcttgatgttcagattagccatgttcacggccctccttaacctacgatctcgctgacgctcttaccgcggatgcgggcgacctcctcggggccacggagggacttcaggccctcaaaggtggcggagaccacgttctgcgggttgttggagcgcaggcacttggcgcggatgtcacggatgccggcggcctccatgacggcgcggacggggccgccggcgatgatgccggtaccgggggcggcgggcttgagcagcacgcgtccggcgccgaactcaccgatgacctcatggggaatggtagtgccggacagagtcacggtgcacatattcttcttggcgtcctcgatgcccttgcggatggcctcgggcacctcagcggccttgcccagaccgaagcccacgcggcccttctcgtcgcccacgaccatcagcgcggcgaacttgaagatgcggccgcccttcacggtcttggacacgcggttcagagcgacgagcttctcggtaaactcgctgggttctctctcaaatctagccatttatcgttttcctcctcccttagaactgcaggccgccctcacgggcgccctcggccagggcctgcacgcggccgtggtacacgtagccgccgcggtcaaacacgacggtctcgatgccggcggccttggcgcgctcggcgacagccaggcccaccttcttggcggcctcacagtcggagcccttgccctcgaagcccttctccagggaggaagcagacaccagggtcttgccggtcacgtcgtcgatgacctgggcatagatgttggtgttgctgcggaacacgttcaggcggggacgctcgggcgtgccggaaatcttgccgcgcactctcttgtggcgcttaagccgctgagcgttggtatcgggtctgttgatcatagtggcacacctccttatttcttcttgacgccggtcttgccttccttgcggcggatgacctcgtcagtgtatttgatgcccttgcccttgtacggctcaggcggacgcttctctctcacttcggcggcgaactggccgaccttctgcttatcggtgccgctgatgacgatcttgttggcgctgggcacctcaatggtgatgccctcgatctcctcgacggtgacctgatgggagaagcccaggttcataaccagcttgttgccctccttggccacacggtagcccacgccgttgacgtccagctccttcttgaagccctcggtgacgcccacgatcatattgtgcagcagggtgcgggtcaggccgtgcaggctgcggttggccttctcgtcgttgggacgggtcacatgaatcacatcgccctcctgggtgatggtcatggcgggatgcatctgctgcgtcagggtgcccttgggaccctttacggtaaccaggttaccggcttcgatcttcacgtccacaccagcggggatggagatcggcattcttccgatacgagacatattctactctccctccttaccagacaaacgccaggacctcgccgccgacatgggccgcgcgggcggccttgtcagtcatgacgcccttggacgtggacacaatggcaatgcccaggccatgcagaacccggggcagctcgtcagcaccggcatagacacgcaggccgggcttggagacacggcgcaggccggtgatgaccttctccttgccgggattgtacttcagggtgacgcggatgacgccctgggtaccatcgtcgatgagctggaagttcttgatatagccctcatccagcaggatctgcgcgatggacttcttcatgttggacgcggggacgtccacggtgtcatgcttggcgttgttcgcgttgcggatgcgggtgagcatatccgcaatgggatcagtgatgtgcatgatgtttacctcctattagagttacgggcagggcccgtatcagcggcaaggtatcgcagctaggcaactgcgacctattgctcgccggcgggggatttattcaaattaccggccaagaggcgggctggctttaccagctcgccttcttgacaccgggaatctgccccttgtaagccagctcgcggaagcagatacggcagatgccgtagtcccgcaggtaggcgtggggacggccgcagatcttgcagcggttgtagcggcgggtggagaacttgggctccgcctgctgcttcaggatcatagacttcttagccatttcgttctcctcctttagcgggcgaagggagcgccgatcagggacaggagctccttggcctcttcgtcggtcttggcggtggtgcagatgaccacgtccaggccgcggatcttatcaatcttgtcgtactcgatctcggggaagatcagctgctccttgatgcccaggccgtagttgccgcggccgtcaaaggcgttggggttgatgccgcggaagtcgcggacgcggggcagggccacgttgaacaggcggtccaggaactcccacatgcggtcgccgcgcagggtgaccttcgcgccgatgggcataccctcacgcagcttgaagttagccacggacttcttggccttggtaatgatggccttctggccggtgatcttggtcagatcgcccacaacggcctccagaaccttggagttgtcacgggcctcgccgcagccgcagttgaccacgatcttgtcgatcttggggatctgcatgacggacttgtagccaaacttctgcatcagagcaggagcgacctcggcctggtacttcgccttcaggttgggcactttcttatcagccattattgttcactcctcctctctcagatctcggcgccgcacttcttgcagacgcggaccttcttgccgccctccagcagcttgtgggcggggcgggtgggcttgttgcacttggggcagacgcgctgcaccttgcaggcatagatgggggcttccttcttgaggacgccgccctgctcgccctgcttgcggggcttggtgtggcgggagacgacgttgatcttctccacgaccaccttgccggacttgggcatgacctccaggaccttgccctgcttgcccttgtccttgccggacaggacgacaaccaggtcgtccttacgaatgctcatcttattcatgtcttctcctacccccttacagcacttcgggagccagggacaggatcttcatgtaatccttgtcgcgcagctcacgggccacgggcccaaagatacgggtaccgcggggattcttgtcgtccttgatcaggacggcggcgttctcgtcgaagcggacatagctgccgtcagagcggcgcacgcccttgacggagcggacgatgacggccttgacgacctcgcccttcttcacggttccgccaggctgtgccttgcggacggaagcgacgaccacgtcgccgatgttgccgaacttgcggctggagccgcccagcacgcggatggtcttgatctccttggcgccggtgttgtcggcgaccttcagatagctttcctgctgaatcattccggcacctccttacttcgccttctcgatgatctcgacgacgcgccagcgcttgtccttggacaggggccgggtctccatgacccgcacgcggtcgccgatgccacactcgttcttctcgtcgtgcgccttcagcttataggtgctcttgacgatcttcttatacagggggtgggccacacggtcggcaatggccaccaccacggtcttgtccatcttatcggaaaccaccaggccgactctggtcttgcgggaagaagttctgttctccatgatctcgttcctccttcttatcggcctgcgagctgctgctcacggatgatggtcttcacgcgggcgatgtcgcgcttgacctcagcaatcttcacggggttgtcgagctggttggtggcatgctgaagacggagctggaagagatccttcttcaggtcgcccagcttgctctccagctcagcggcgctcatcttgcggatttcagtagccttcatcttcattcaccaccattctcggtctcggcggtctgcttcgccacgatcttgcacttgacaggcagcttgtgggaggccagacgcagggcctcgcgggcagtctcctcggaaacgccggcgatctcaaacatgacacggccgggcttgaccacggccacccagtactcgggggagcccttaccggaacccatgcgggtctcggcgggcttctcggtgatgggcttgtcggggaagatcttgatccagaccttaccgccacgcttggtgtaacgggtcatggcgatacgggcggcctcgatctggttgctggtgatccagcagggctcggtggcctgcaggccgaaatcaccgtaggtcacggtgttaccgcgcatagccttgcccttcaggcggccgcggtgcacgcggcggtatttcactctcttaggcagcagcattagttggagcctccttccttgggagcagcgggacgggcgccgccgtggggacgggcaccgccctggggacggttgttgttgaagccaccctggggacggccgccgttgcggttaaagccgccgttgcggttgaagccgcccttgcggtcgccgtcacgccggtcgcggcgggggcggtcggagcgctccttgaagttcttggtgtccagggtacggggggtggtgcgcagggtctgggtcagcacctcgcccttgtagatccacaccttcacgccgatgcggccgtaggtggtggcagcctccgcgaagccgtagtcgatgtcggcgcgcagggtctgcaggggaatggtaccgtcgtgatagtgctcggtgcgggcgatctcagcgccgcccagacggccggacacctgagtcttgatgccgcgggcgcccatgcgcatggcgcggcccatggcgttcttcatggcgcggcggaagccgatgcgcttctccagctgctgggcgatgttctcagccaccagctgggcgttggtgtcgacctgcttgacctccacgatgttgagggcgacgggcttgccgatcatcttctcaacggtcaggcggtactgctcgatctgctcgccgcccttgccgatgacgacgccggggcgggcgcagtgcaggtagatgcgaaccttggcattgtcgcgctcgatctcgatcttggggataccggcggaatacagggtcttcttcaggtagtcccggatcttcttgtcctccaccagcaggtcgccgaccttctcgttgcgggcgtaccagcgggagtcccaatccttaatgacacccacgcgcaggccgtggggattcactttctgtcccatattcttcctcctcccttagcgctcagccaccgcgatggtgatgtgagaagtgcgcttgttgatgcgataggcgcggccctgggcccggggcatcatccgcttgatgatggggccggggcaggcgaacacctgggaaacatacagcttctcggggtccatctggtggttgttctccgcgttggacgcggcgctcttgaggagcttcagcagcagctcggaggcagccttgggggtgcccatgaggatggcgttggcctgggccacgctcttgccgcggatcaggtcgcagacgatctggaccttacggggagagatacgggcatatctcagatgtgctttcgcttccatgtttctctcctcctccttacttaccagtcttgctgccggcgtggccgcggaaggtgcgggtgggggcgaactcgcccagcttgtggcccaccatgtcctcagtcacgtagacgggcacgtgcttgcggccgtcgtgcacggcaaaggtgtgtccgacgaaggaggggaagatggtggaggcgcggctccaggtcttcaggaccttcttctcgccggtctgattcatttcgtcgacccgcttcagcagctcgggggcgcaaaaggggcctttcttgatacttctgctcatcttttactgcctcccttacttcgcgttgcggtgcttgacgatgaacttctcggtgcggttcttcagcttgcgggtcttgtagcccatagccggcttgccccaaggagtgacagggccgggacggccgaccgggctcttgccctcgccgccgccgtgggggtggtcacaggggttcatgacggaaccgcggacggtgggccgccagcccatgtggcgcttgcggccggccttgccgatctggatgttggcccagtcggtgttgcccacctggccgatggtggccttgcactcctcgcggacgtagcgaacctcgccggagggcaggcggacctgggccatgccgttctccttggccatcagctgggcggcgtcgccggcggcgcggacaagctgggcgcccttgccggggtacagctcgatgcagtggatcatctcgcccacggggatgttggcgatgggcaggcagttgccgggcaggatgtcggcgtcgggaccggtcatgatcttgtggccggccttcaggttcacgggagccaggatatagcgcttctcaccgtcctcgtactggatcagggcgatgttggcggagcggttgggatcgtactgcaggttgatgacggtagcggtgccgttcttgtcccgcttgaagtcgatgatgcggtacttcttcttgttgccgccgccgcggtggcggacggtgatgcggccgtagctgttgcggccggcgttcttcttgagattctcggtcaggctgcgctcgggcttggccttcttgtcgatgccctcgaaggcgctcacggtcatgtggcggcgggagggcgtcgtgggcttataagtcttgatagccattgttcgttatcctccttacaccatgccttcgaagaactcgatggtcttggaatcctcggtcagggtgaccatggccttcttccaggagggacggcggccagccgggaaccggccggtgcgcttctccttgccctgcatgttcagggtgttgaccttggcgaccttcacgccgaagatctcctcgacggccttcgcgatctcgatcttgttcgcgctcttggcaacctcgaaggtgtacttcttggcctcggtctccgccatggactgctcagtgatgatggggcgcttgatgatatcataagcggtggtagccattacgcaaacacctcctcgatgacggccagggccgccttgtcaacgataaactttccggcgttcacgatgtcgtaaacgctcaggatcttggcggtggtggtgaccacgccggggatgttccgggcggacttgatgacggtctcgttcacctcgggggtgacgacgacggccttcttggcgccgacggtatccaggaagcccttcatggccttggtcttgacctcgtccaggttcaggctgtccacgacgacgatgtcgccggaggcggccttggcggagagggcggacttgagggccaggcgcttgaccttcttattcagcacgtagctgtagtcgcggggcttgggggcgaacacgatgccgccgtgggtccactggggggcgcgggtgctgccctgacgggcgcggccggtgcccttctggcgccagggcttaatgccgccgccggagacctcggcgcgggtcagggcgctctgggtgccctgccggcagttggccaggtggttcttgaccacctcgtggacgacggtctggttgggctcgatcccgaacacagcttcggagagctccacctcgccgacctgcgtgccggccatgttcacaagaattgccttaggcatttggtttctctcctttcttacttgttacgggcggaagccttctggggattgacgcgggcggaagccttctgcgggttgctggagataccagcggcggcgcccttctccttgacgttgatcacggagttgcgcagatacacgatgccgcccttggggccgggaatcgcgccgcggacggcgaggatgcccagctcggcgtccaccttcaccacgtccagattgaggacggtgacctgctcgttgcccatctggccggcgccgatcttgcccttgaagatgcgggaaggatcgctgttggcgcccatggagccggcgtggcggaccacaggaccggagccgtgggtctccttcagacggtgagcgccgtggcgcttgatgacgccctggtagccgtggcccttgctgatgccggtcacgtccacgcggtcgccctcggcgaacacgtccaccttcacctcgtcgcccacgttcatctcggcggccttggccagcttgaactccttcagggtcttcttgcgggcgtcgccggccttcttcaggtggcccagctcaggcttggtgagcttgcgctccgccacgtcgccgtagccgagctgaacggcgttgtagccgtccttctcctcggtcttcttctgcaccacggtgcaggggccagcctcaataacggtgaccgggatgaccttgccgtcggcgtcaaagatctgcgtcatgccgatcttcttgccgataatggccttttccatgatagttcctccttaataaggttattggttgaaaaacgtgggcattggctcccattggttttccaacttgacccgtccgcctcaaaagcgcggcggactgcgggtacacaaaggtaattgtctgagatggctgtgtcacgctgcgaagccttcgcaacgtcacgctgttcatcgctccgtgaaaaatgccgctccgcctttggcgtcgcctgttttttcacctgcgcgattcactgcgtgcctgctcccggcttctccgcgcttcgttacagcttgatctcgatctcgacgccggcggggagctccagggacatcagggcctccacggtcttgggggagggcttgaggatgtcgatgaggcgcttatgggtgcggcgctcgaactgctcgcgggaatccttgtacttatggacggcgcgcaggatggtcacgacctccttcttggtgggcagggggatggggccggacacggacgcgccggtgcgcttggcggtctccacgatcttctcagcgctctggtcgatgagctggtgatcgtaggccttcaggcgaatgcggatcatttctttctgagctgccattgtggttcctccttaaaaacatacgaagtggtgggttgagcacgcttcgtacggtgagaaatcttcagtacacgtttccgtgcgtatcactccgtgacatgaagaaaaccggcacaagcaggccggtttactccctgcgcggcgatatacgccgtgcacggactcctcagccgcccgattctagctcggacatactccgcggaagttaccggctcgcgccgcaatctcccgcatcatcgcagactgcgcccctttacaggcgctctgttataatacctgaaaaatcccgtcctgtcaatagatttttccggttttcgtaaaatttatttcttcactgggtccttggcccggcagcccagccaggaggacagcaccagcagcaggaatgcgccgaaatagaaccagaacacctgtccggtccacatggccacaatagcgcccaggcgcagaaggggcagatagaagaactgggtcagcaggcccactgcgttgtcccagtaggcgtgaagggacagctcctgcacccccagcagcaccagcaccaccagcgctggaaggttgatgcacagcatggtgagcgccatgcccctcttggagcccttgaagccaaacgtgccggagaccaccatccacagcgtcagcacggccagacctaccacgatgtagaaccaggcgcccatctgggcaaaaattgtcgtcatccccagactgagcagccatcccagcaggaaggggctcagtcccaccagaaacagcaccgcggctttgcgcatgcaatcacacctctttcatcatacggcattttttaccgctgcacagcataccacaccccggcggcctctgtcaaccgggtcgccggggcgcgccttacggcagcagcacgtccgccagccgccgcttcatctccgcggcgtcgatggccgtgccggtgaagtgctccagggagagcaccgcctggttgaccagcagtccgaagccgttggcggtctggtgccccccctccctggcccggcggagcagctcagtctccgccggggcgtagatgagatccaccaccggtgccccggcgggcagggcgtccaggaaggagaactcctcaaactgccctgccgccccctccatacccagggaggtgcagttgaccagcagcccgcactccgccgcctcccgccgcagggtatccgggtcgaagccggcggggcgcaggcgggccggctcgtgggcgcagagggcggcggccttgtccgcggtgcggttgcacactaccacctccgccccggcctgggccagcttgaggcacaccgccttggccgcccccccggcccccagcaccagcacccgcttcccggcagggtcgatgccctcgtcgttcagggcgcggagaaagcccgccccgtcggtgttgtagccataggcccggccgtcccggatacagacggtgttcaccgcgccgaagaggcgggcatccccgtccagctcgtccatcaactccaccagctcctccttgtggggcatggtggcgttgaacccggcatagccggcaaatttggcgcattccagccactcccggcatctcccccggggcaccggctggcagaggtagacgtagtccagccccagggcggccagcatggtgttctgaatcagcggggacttggagtggagcaccggctcgccgatgacgcagagctttttcgtgctgtttttcacttccacctgcatgtgcggggcctcctttttgggttcgggccgcagatcggggagggcggcgttcacccccaaagcgataagcaggcccaccaccgtctcaatgatgcgggcggcggcatagtagtaccgggtcacaccggtgacgccggtgatgagaatgacgcagggcaggatgcacgccatgccacaggcggtgggccgcttgagcagcaggcagatccacacccccgccacgcacaccgcccccagggcgggtatgcgtacccagggatcgtccagggcggcgcccagcagcagggtggcggtacccagggctccgcccaccgccacgccgatgaggcgggagaggccctgctggatggtctggcccagggtggactgggtgcagatgatgcaggcgatgcaggcatagagggggccgagctggccccacacgccccccagcgcctcgttatagatgaggccgaagggcacgaaaatggtataggacagcatgaccgccacggcggtcttgaccacccgcataccgatgcgcggcaggggcacgcttttcatcttctccccctcctcgatccgccgcagcgggtcaaaaagtccagcagcaggcggttgaacgcctcgggcgcgtccagattgaccacatgggccgcgccggggagcaccgccgtctccgtctccggccaggcccgcttccagtcctccatgtgccgggcgatggtgccggtcctgtcccgctcgccccggcacaccagcaggggcgcgtcgaaggagaagtgtttctcggggtggaggcattgagcgattccccgccagccccggagaaactcccgccgggtgagctggtcgaacatgcggcgtaccgccgcccgcccctcctctgtagaagagcaggccatggccatggcgcttttgagacacctccacggccacacccccagcaagggggtggaggcccgcaggcccgcccgctcccagccgctatagcagtccaacagaataggggtagctccggccaccaggtatccggcgcagccgccgaactgccaggcgtactcctggacgacatagccgcccatggacagccccaccagcaccggggcgcggcagcgctcctttaccagcacggcccggaggtcctcggcggcctgggggatggagaagtcggcacagggccgggagtccccgtggccccgtatgtcgagattgagcaccgtccacccctccagggcagcgagctggggcgcccacatggtgcggtccagcccgtagccgtggaggagcaccacctccggcccctccccctgccggcagtcgtaggcgatccggcagccgtcagagcggacggctcttgtctcccagtcagccatgggggttctctctgctttccttctcgttccagagaaagtaggacatggccgcctcgtagccgtacaggcccaggccgcagatctggcccacgcaggcgggtgcggtgacgctcctgtgccggaactcctcccgctggtggacgttggatatgtgcacctcaatgcagggcacgtccaccgccttgagggcgtccaggatggcgtaggagtagtgggtatacgccccggggttcagcacgatggcgtcgtacacgccgtcggcggcgtggatggcgtcgagaatggccccctcgtggttggactggaagcactccgccgtggaggcgtgggcggcggcgaactccttcagccgccggcacaggctctcatagctgttctccccgtagatgcccggctcccgcttccccagcagattcaggttggggccgttgatgatcaggaacttcacgcctgacactccctttcataaagggccgcgatgcgcccggccgcctcggcggcctgggtatggccctcgatgatgtagtccgcccaccggcggtagatgggctcccgctggcggaaccgctccagaaacgcctcttttcccccctggcccagagggcggcgcgccatggacactgtgtcgtagatcacggccggctcccggctgagccagaagaccacgccgctggctttgagggcggcaatggcctccgcccgggtgggcaggccgccgccgcaggcgatgaccagccctccctcccgggccagcgcccggctcacgtccagctcacgggcccggaagccctcctccccctccgacgcgaaaatctccgggatggtgcggccggacgcccgctcgatgcgctcgtcggtgtccacgaaggccaggcccagcttctccgccgccagccgccccaccgtggacttgccgcagcccatcatgccgatgaggatgagattgttcacggctcatacccccggaagttccccaggatacggaactcggcggccagctgccccagctcgtggagcacgccgtccatctccggggcggcgagatcgccggtaaagtccaggaagaacaggtattcccagccccggccgggaatgggccgggactcgattttcagcaggttgagcccctggacggcgaacacggtgaggatctcgtggagggagccgctctggtggggcaggcggaacacggtgctgatcttgttgcggccgggccgcagctccagcaccggggacaccaccacgaaccgggtgtggttcatggcgttatagttgaccccctcggccagaatatgcagcccgtagatctcggcggcccgtcgggagcagatggcggcggcggcgcggtcgccgctcccggccacctgcttggccgagccggcggtgtccaaggtgggcacccgccgccagccccggtgggcgtccagatacctctcgcactgcatcagcccctgctcgtgggagtagaccgtctggatgtcctccagcgccacgccgggcagggccatcaggcagtgctccaccttcacctggcactcccccaccacgtagtagttgtactgggccagcagatcgtagacctgccggatggagccggtggaggagttctccaccgggagcaccgcgtagtcggcctccccccgctccagggcggcgaacacgtcggggaaccaggccagcccccggctggacacctccgggccgaagaagcccacggcggcctcctcgctgtagcacccaggctccccctggtagaccacccggggggcggccaccggctcccgccgggcggccagggccgccgcataggccgcatagcccggctcctccgccccctcccgcaccagcttgcgctgctggcggcgggaaatggccatgatctcctcgtagagggccgccacgtccgccttgcgggccggatcgtcggtgagggccgtcttggcggcgatcacctgcttctcccgcccggcgtccagcaccgggatacccgcccgctgcttgtactcccccaccttgccggtgaccgccatccgctccagaaagagctgcaccagctccccgtcgatgcggtcgatctcttggcggtattgctccaattcggtcatgttccctctctcctttgtctcctcgaggcggcggccgggcgcttcctttcgggcgggtgtgggcacccgcccctacatttaaacctggccgcacgctccgctgccccgcctctgcgccatcgcgcgaggcggccctaaattcccagcacctcgcacgccgccagcgccgccgccgcaccccagagcgcactgcgcgcgctccgggaaccccacagtttatcttcctcggcgggagtgaatcccgccttcggcaaggttttgcctccggcaaaacgcttggacgccgcttccgcggcggctcgctcccgctcgcgcgaggcggcggccctaaattcccagcacctcgcacgccgccaacgctgccgccgcaccccagagcgcactgcgcgcgctccggggaccccacattttattctcctcggcgggagtgaatcccgccttcggcaaggttttgcccccggcaaaacgcttggacgccgcttccgcggcggctcgctcccgctcgcgcgaggcggcggccctaaatccccagcacctcgcacgccgccaatgctgccgccgcctcgattacgggcacggcgcgggggacgatgcaggggtcgtgacggcccttgatctcgatctccgtctcctccccggtgcggaggtccacgctctcctggggcagagcgatagagggggtgggccggatggtgacctcaaaggtgacgggcatgccgttggtgatgcccccgttgacgccgccggcgtgattggtcttggtgaccacccttccgtccttcacctcgaaggggtcgttggcctcgctgccccgcatgagggaaaaggccacccccgcaccgaagtccacgcccttgacggcggggacggcaaagaggtgctgggcgaagataccctccacgttgcggccgaagtcgggggcccccagcccggcgggcaggccgaacacggcgcactcaatggcgccgcccacgctgtcctgctcatttttggcctccagaatggcctggcgcatctcctcccccttggcgtcgtccagcacggggaagggcttggccgccacggcctccaatgcgccggcgtcctccagggaggcgtcggtgatgccgtagatggagctgatatgggcgcccacccgcacgccccgtagggccaggagctgccgggccaccgcaccggcggccaccaggggggcggtgaggcggccggagaagtgcccgccgccccggtagtcctggcacccctggctcttgacgaagccggcatagtctccatggccgggccggggggtgtagcggatggcctcatagtcctgggagtgctggtcggcgttgggaatgagcatggccagcggcgcgccggtggtcttgccctcgaatacgccggagagcacctgcaccgtgtcgctctcccggcgggcggtggcggtggggtcctggccgggcttccgccggtccagctcccgctgaacggcctccagatccagctccaggccggcgggtacgccctccagcaccacgccgatggccgggccgtgggactcaccgaaaatcatgtgtcgcatgtgggttcccttcctttgctttctcaggttttgtgccgggaggccccggcctccgggcgggtgtgggcactcgcccctacggtattcatacgaacgcggccggatgctttgcgcttttgtgtaggggcggcccttgtggccgcccgcgggcggggacaagccccgcccctacaccattcgtgtaaaaacggctccgtggccgcccgcccctcctacgtccgggcgatctgaccgcccagggcctcgtagtctgcccagaagcggggataggacttgttcacgcactccgcgccggtgatggtcaccggcccctgacagcgggtggccgcaatggcggccatcatggcgatgcggtggtcgttgtggccggagacagtgacgccccccgccagccgctccctgccccggagcaccaggtggtcggcgtgctcctccacaccggcccccagggcgttgagcacctgcgtcacagaggccagccggtcgctctccttgatgcgcaggcgggcggcgttgacgatggcggtcgtctcccccgcccgcagggcggccatggccgccagagggggcaccagatcggggcactgggacacgtccagctccgccgggccgggctgggtcaggcgggcaagctgctccccgatcacccggtcgccctggacggagcgggggttcagcccctccacgtccacccggtggcccaggaacgcggcggcaaaccagaaggcggcgttggaccagtccccctcgatggccagatcccggtggcggtacgcctggttccccggcacccggaagcgccggtccccgtcgtactccgccgagacgccgaattgggccagggcgtccagggtcatgtccacatagccccggctctccagcgcggtggtgaggacaagctcgctgtccccctccagcagtgggagggcgtagagcaggccggtgataaactgggaggacacgtcgccgggcagggcgtagacgccgggcgtcagccgcccctccacggcgagcaccccgttttccagcgaccacgcaattcctttctccgtaaagaggcggaaatagggctcctggggccgctccatgagccgcccgtggccggtgaaccggccgccccccttgagggccagggccacggggatcaaaaacctcaaagtggagcccgactcgccgcagtccatgatctccggcgggggcgtctcaaagccgtccaccaggtcggccccgcggattaccgtgccgtcggcggaggcgtccgcgtccagggtgcgcatacatcgcagggtggcctggatgtcctgggacagctccacattggacaggcggcacaccccgtcggacagggcggcggcgatgatcagccggtgggcctgggacttggagggcggcggggtgacggcgccgcccagggcggcgggggtgatggtgacgttcatcgcagttcctccagcagtttggccttgggcatccggtgggggacggcgcggcccatgcgctccaggaggatcaccgaaatgtcctcccccgcccccttcttgtccagtcccacggcggcggcgtaatcctccgccgtgcaggggatggcggtgggcagccccagggcggagagcgcctcctccaggcgctccggcagctccgccggggtcacccccaggcgtacacccagccgggcggcggcgcacatgccggcggccaccgccgcgccgtggctccactcggtgtagtgccccgccagctcgtaggcgtggcccagcgtgtggccgaagttgaggagcatccgctcccccgtgtcccgctcgtcctgttccactacgctccgtttaatcgcgcagcaggtatacaggatgtgttccatttccgccatcagctccgcccgggagggccgggccgccaggaagtcgaagaaggccgcgtccctgatgcagccgtatttgaccacctccgccatgccctccatgaacacaggcagcggcagggtgtccagcacctccgggtccatgagcaccagcctgggctgccagaaggcccccgccagattctttccgtactccagatccacggccaccttgccccctacggaggaatccacctgggccagcagggtggtggggatctgcacgaagtccaccccccgcaggatggtggcggcggcgaaccccgccagatcccccaccacgccgccgcccagggccgccaccgcgtcggtgcgggtcagcccggcgtccatcatggcctcccacagctcggccagacgggcggcgcatttggagctctccccggcggggacggtgtgggcggtcacccggaatccggcttcctccagactggcccgcacccgctccaaatacaggggggccacatggctgtccgtcaccacgaaaagccgggaggccccgggcaggacggcccgaagctcctcccccgcccgggccagtagcccccgcccgatctgtatgttgtattcccgccccggcagggcgacggtcagcgttttcatggtacggcctcctctgttcaaaatcgacggtatccgtcgggcgggtgtgggcacccgcccctacgctacagctccgcaggttgccccaacgcaggggccggcaccccagggcggcctctcttgcccctgtggggcaattcaccttctgccctcatcggcccacgccaactatcctccaccctcaccgtaggggcggccctcgtggtcgcccgcgggcggggacaagccccgcccttacatactggtgcggggtgcgccccgccttcggggcccccacacgaacccagcgaagcggttcgcgtggggaaaaggagccgcagcggaaggagtgagctttgccgctggcggcgaagcgaaggatctggagcttgcggcgacgctgtcacgctgcgggttgggcgcatggccgggtcgctaaacggccattccgcgaaacatgccgctgggcttcgcccagcctgttttttcgcctccatgtcctcttagctcccctatgcgcctaccctccgcgcttctttttttattttaccagcgttttccccatcaggtcaaccatggcggagaccttgtgcatgagggcatcgaagttctggggggtgagggactgctggccgtcgcatttggcgtgggccgggtcgttgtggacctcgatgatgaggccgtcggcgccagcggccacggcggccagggccaggggctccaccatccagtacatgccggcggcgtgggaggggtccacgatcacgggcaggtggctcatctgcttaatggcggggatggcggacacatccagagtgttgcgggtgtaggtctcgaaggtgcgcaccccccgctcgcagaggatcacgttctcgtttccggcggacatgatatactcggcggacatgatccactcctcgtaggtgttggacaggccccgcttgaggaggatcggcttgctcatcttgcccacctccttgagcagttcgaagttctgcatgttgcgggcgcccacctgcaccacgtccacctcccgctcgaagagctcggccatgcgggggtccatgatctcggtgacgatgggcaggccggtctgcttccgggcctccatcagcaggtcgaggcccgcggtgcccatgccctggaaggagtagggggaggtgcggggcttgaacgcgccgccccggagcagggccgcgccggaggccttcacgtcctcggccacggcgcagatctgcgcctcgctctccaccgagcaggggccggcgatcacggagaaattccccccgccgatcttggcgttccccacggagaccaccgtgtcctccgggtggaacttgcggttggccttcttgtagggctcctgcacccgcatgacccgctccacatgggggttgatggagatcttatccatgtccacggcggtggtgtcgcccaccaggcccaggatggtgcagcccacgccgttggtgatgcccacatccagatccagttccttaagcctggataccaaggcgtcgatgtcctgctgccgggtgccgggtttcataacaactaccatgattttacatcctttctctccatgcaaaaagggcgcccattgatgaaatcaatgagcgcccctgcacgttcaggtactatggggccttccccgggccccacccattcattccatcccccgtgttttctccacgccaaaaaagccggcgcccataaatcgagcccagccataggaaaacaggaaggatgcagttgtgagggttcggtctgccatgtctgtgctcctcactttaacaggttggtgtcattatacccccatcgttagcggaatgcaacgggaaattttcaaaaatcccggttttttgccctgggatagggcgtccgctcgtccgtgaggcctaacaggtagtccacgctggtgttgtaatagcatgccagcctgatcaacacgtcaatggggtagttgagcaccccgatctcgtactgggagtacgtattctgtctgacgttcagcagcgctgccacctcccgctgggacaggttgcggtcaatgcgcagattgcggatgcgctcataccgcagcacttcatttcgcatagaatcacccagagcatcttaaaatatctgaaattcagatattgcattttatctgattatcagatattctaaacaggaggtgagcacgatggatgaagcggaagagcgtcggatctggaagcgggatgcggcggagctgcggcggtccgaggtctacccggcgctgctccgcttgcgggcggcgctccggcggcagacccccgccgatcggatgctgctggcctgggtggagcgggttctgaggagtctggatacctctgctccgtaggggcggggctcgtccccgcccgccagagagtgcccggggcgcgggcggccacaagggccgcccctaccgcacaaggtagggcggctcaccccagcgccacgtccagcaccatcatgagcaggaagcccgccatgactcccagggtgccggtgttggaatgctcccccaagtgggcctcggggatgagctcctccacaaccacatacatcatggccccggcggcgaaggacagcagccagggcatgaggggctggatcgtccccgccaccagcaccaccaggataccgaagacaggctccaccacgccggaggcgctgccgtagaggaaagcccgcccggcggacagcccctcctgccgcaggggcagggagatggccgccccctccgggaagttctggattccaattcccagagccagcgccagggccccggacagggccgccccctcaccggcgtgctgggcggccagggcgaaggacaggccgacggccatcccctccgggatgttgtgcagcgtcacggccagcaccagcagggtggtgcgccgccaggaggagtggagcccctcgggctgcctggcatccacatggaggtggggcagcagcacatccagcagcagcaggaagccgatgcccagcacgaagccccccaccgccggcagccagcccggaagcccggaggcctccgcctcctccatggcgggaatgagcaggctccacaccgaggcggcgatcatcaccccggcggcaaagcccagaaagatacgctggatggacgcattgagctgctttcggaacagaaagaccatggcggcgcccagagtggtcatcaaaaaagtgaagccggtacccgtggccgcccataaaatggattgcatgagttccctcctttttctggttagtcatagttaatcatctgatattataaggggggcggcatgccgcccccctttgaagcgtcagtacgccacgccccagtacaccatgtgcttggcgggcttgccgcagcaggcgcaggtgtcgcccaggtgctcctgctccagagggatgcaccgggaggacactccggcctcctccttcatcttcagctcgcacgccagctcgccgcaccacatggtcttggcgaagccgccctggctggccatcttctccttgacctcctccagggtggcgcaggcgtaggtattctcgtccaggttgcgcttggccttgtcgaacaggccctgctgcaccgcgtccagcatggtcttgacggtctcctcgatgttgtccagggagacaaagctcttctcgccgctgtcccggcgggccaggacgcactggttcttctcgatgtccttggggcccagctccagccgcaggggcacgcccttcatctcgtactcggcgaacttccagccgggggagttgtcggaggcgtccatcttcacccggatgccggcggccttcaggcgggccatgaccgcctcgttggcggcaatgacgccctccttgtgctgggccacggggatgatgatgacctgggtgggggcgatgcgggggggcagcaccaggccgttgttgtcgccgtgggtcatgatgacgccgccgatgaggcgggtggacacgccccaggaggtctggaaggggtggtggggctggttgtccttgccggcgaaggtgatgtcgaaggcgcgggcgaagccgtcgccgaagtagtgggaggtgccggcctggagggccttcttgtcgtgcatcatgcactccacggtataggtggcctcggcgccggagaacttctccttgtcggtcttgcggcccttcaccacgggcatggccaggtagttctcgcagaaatcggcgtagatgttgaacatgcgctcggtctcggcgatggcctcctcggcggtggcgtgcatggtgtggccctcctgccacaggaactcccggtggcggaggaaggggcgggaggtcttctcccaccgcaggacggagcaccactggttgtacagcttgggcagatcccggtgggagtggatgatgttggcgtagtgctcgcagaacagggtctcggaggtggggcggatgcagtagcgctcctccagcttctccgagccgcccatggtcacccaggcgcactcgggggcaaagccctccacgtggtccttctccttctggagcagactctcggggatcagcatgggcaggtacacgttctcatgcccggtttccttgaacttctcatccaggatcttctggaaattctcccaaatggcgtagccatagggacggaggatgaacatgcccttgatggaggagtagtcaatcagctccgcctttttgcacacgtcggtgaaccacttggcaaagtccacctccatatcggtaatctgttccacctgtttcttgtcctgtgccatctctatctcaatcctttattctaaagttatcggttcgtattattttacgcattcaggccgcaaaagtcaaggcccgcgctgcgttccgggacaaatggcgcataaaatcccatattttccgcacactacagcaaagcgggaggtggcggagcttgcgtgtgggaatctgggagcgggacgaggggattcggacggccgtggaggccgggttgggagagctggcggcggaggtgcgcgccgggcggcacccggcggagctggccggcgcgcggctggagctgctgacggtgtcaccggcggcacggggctgggccggcgcgggggccgtcccctgcgggacggtgctgctgcccggcacggcagggccgctggcccgggccctcaacgcccgccaggccgtgagctacggcacctccccccgggataccctcaccttttccagcctggagggggacaggctgtgcctggccgtccagcgggagctggtcaccctgggcggggcggtggtggagcagcaggagctggtgctccccttctctaccggcgcctcccccctgccctttctggccgccgcgggcactctgctgctcctgggtgtgccgccggaggagctgccggcgcggttccgcctcccggcgtgaggcctgcaaaacggccccagaaccgagcggttccggggccgttttcatgtcattacatttaatacttacagctttagcaccagagtggctacaaactgggctcccttgtaatcgccgaagagctgcacccggtcccccgcctccaactggcgcaggctggtggaggagccgctggcggacataaagctggcgtcggacacgtccgccgtgagcacgttgccgtcggtgagctgtaccatcagggtcttgtccttggtgttgggcaccaggaccgtgccctcaagctggctgctggagccggagcccctgtccacctcgatggacaccacatctccgccgctgaccaccatggccactgcatcgttgggcttgagggtgtagagggagacggcggtgccgtcctgggtgacagaaacgccctcggacacggtgtaggaggcggtggagccgtcggtgagcttcacatcaaacgtgatcccggcggcatcctgcaccacccgggtgatagtgccggtgacgtttgcgctctgaggcgtggtctccagggtggtgaccttgttgtagcgcacggtgaccaccacggtgtcgccgctcttgatcttgtccagagagctgctcttaccgtcccggtagatggcgggcaggtcggtgagatccagttcaaaggtcattacgctgtcattggcggtcttgaccgccagggtagtgggggtaccgtaggtgatgctctcaatgacgccctcggtggtggtggagccaggataggcgtccagcagcgtcaccacatccccgccggagagctgaagggtggcgaaggagttccgctccagctccttgagtgcgatgtcctcgccattgaagcggatggctgccttggaggagatgtcgtaggtggtggatttgccggtactcaggttggtcagggtgatgtcgttttgatccttggcgtaggtaaagctcttgacggagccctggacgtaatcggttacggtgtccaccgccatgctgaccagctcgttggcctcgtcgttggatacccgcaggctcacgtagtcgccctcatagcggtcggacacggtgcccaccacgccgttgacggtgacgcccgccccggcgggcagggtgtagcgcctggtttcgccgttaaaggccgacacctggagccgctggccgccggtgccgttttccaccttcaccagtatgccctcctcggcgcgggttccgccggagagctgcaccgcgtccagatggcccatggcgtccacatagcaggtggccgtggtgtatccggcctggggatccagcagggtgtagtcgccggcggtcttgcccacctgcacctcggtaaagcggtcgatatccagccgtttggaagcgccgttgaccgtcacggtcaggctgtcctgctccacgccggtgacggagccggtataggaggtgaccgcgccgcccaggcgcacggactcggcagtacccttcctgtccaggttcacccgggcgtaactgcccaccttcagggcatcggcggaggagagcatgttattctcgtagatctccgcgtcggcgggcagggagatgctgcgggtgccgctgaccacgctggtcagggtcagcagggtaacgccgctgctgccggtagacacggcggcgatggtgccgcccacccagtcatagtcggtgtagccgggcagctcggcatagatgccccgctcgtccataaagtcgatggcccggcggagcatggtggccatctcggcccgggtcagggagttctgtggcagaaagcggttgagctcgttgcccttgacgatgccgtacatgttcagcaggtatacatagggctgcagggaggcggaaatagaggtagtgtccgcaaagctcatggggtaggaggtcaggctctgggccaggggggcgagctgcatggcccgcaccagatacatggccagcgtctcacgggtgatggacttcaccagcccgcccgcgctgctcagggcccgcagctcggtctccgagatgatgccggtctccaggcagacggccatctcctgggccgcccaggcgtacatctccttgggcaggatctccttcagctcgtcctcccagtcctcggcgatggcctccttgtcaatggcgtccacgccggtggcacgggagcaaaacagcagcgcttcacaggcggtcatcttctggtctggagcaaaggtggtggcgctgatccccttgaccaccccctgggtggccaagtactccacatcgtccttggcccagtgattggtcatgtcggtaaagctgacggccgctgcgggcaccaccagcagggagagcgtcatcagcgcggccagcgccagagagagaactcgctttcctttcatatgtaatcctccatttgcataaatggtttccatagtatataatatatagtataatggttcctcagggaaaaagcaacagagaaaatcccgccctctttcgccgcttttttccagtgccctgtccatttttcctggcagtccaccgcattttcccataaactctattggatttttaagtttctcttcattgtgcaataaatccctccgcccgggcgttatgcagtcaaacaggaaaacagctcccaaagattgctctgctgaaacattaaaggaggatatgctgactcacttattttgtaactaaaatagattgaaggagaacaggtatgattaggtggaatgacaattatattacgggtatagaaaaattagacaaggaacatcagcagctattccaaatggccgatcaggttttgaataagttacgggaacgaggagatgaggcaaattatcgtatattcctcgtccgggaaactttgacttatataaccagctattttgagcgtcatgctaaggcggaagaggaatacatgcgcaaaatcggctacactggctatacattgcataagatgttgcacgatgaattttgcaatatccagctaaaaaaatatcaagatattgtgaagcgtggtgagtgcagtaaagaagagatacaagattttatcggaagcggaattggatggctattggagcatatagcaacagcagatatggcgatcataggaaagggtattctagccgcgcctgcaaagaagagtgactttgaagcgcgactggaagaaaagatcaatacgctgttgaccgcttctttaaatattgcggcaaatgcgaaaattataggtaggagctatcaaggagaatttttgggaaaggctgtatatcaaaaaatggtatatagtttggattcacgcgagattacaattgtttcaggtatagagagctcatttctacttcgcgttgccgaaatgatctatgggacagaagtgaagaatgagatggacttgatactatctagtctacagttgtttgctgcaaacttctggagatcaataggacagcactttgctggtagtaatactatgatgactatgaagtcgaatagctttatcattgcaggacttctttcagaagaactgaggaagcttaaactaacgcactcattgctctttgcttctgatatggggaaattttttatagctgttaattactgagaattccaaaaacgtgatagagttgcggtgtcattccatggggaatcagaacgaggggcaacggaaactacaacatctgtccgctccagataccagactgctttaggcatatccaacaaggcaagcaggagtgagtctatctttagcctgtgcgtgctttgttaaagcctctgcctgctcctgagcctgtaccatgccatttactgcatccattacccatttttcgcttcagcgttgatagagagcctataaacacaagaaaatagacagctaaagagttatatagtggtgacggaggatgccttggacatgtgggaagaacacttgcccgagcagatataccttctttgggaaaggttgtaaagaatcctattcagaggacttgaaagagccacctggacaggctatagtaacagtaaaaataggccattaactttatttgaaaaagaatactatgacccgccccctgcttaccggcgccgcccagaaataacacgaatagaagcgcagaccgcatctgcccgcggatatttgaaattgcctgggagacacccattcccggcagccggaggccaaaggaaagggacatccttgcggatgtccctttcctttggcacgcctgaggggattcgaacctccgacctaccgcttaggagtagacccgatacgacatcgggaagtggcatctaatgcttaaaaatgcttggaaatacaaggtttttcagcatttcaaatcccatctgatactacgctgtgatagctaattcagagggattttacaccgtccgattggctcgaaattagcaagtctttcgatttttggtggacgttgcaagtgcaagtaaatgtcactatgtaacttctcgtgatgcgaaatgataggaaatcctattcattctcgtgtgagggtgcgggtgtccttagacacagatttcagtctgttttatatatcatttcaaaatgaatttttcaaccagaattattaagaatttcaaaggtttttcagactcaatgattctatgtaatttagacccgccgaagcaggtctttttttatttcagcataatctctctatcctcagcgccgagcatataagcacccttggcaaaagcatcccttgcaagaagctctgctacatcaaccctatcgaacagcatccatatttctttctctttcggagtcagttcatggctatggtcaaacaaatgctcaagtcccaatccttcaagcaatgccgactttgctgctttgtattcctcagctctgccaacatattcgtcgttcctttccttggaaaatgcctcgatattgtcagctctcagatgctcgtaatactcgtccataaagattctatccatactcgttgacctccataacaaaaaaataagggcagacccttttacagctattgtagctatgtaaaaggatctgcccttgcagttactataatgtttttgccagcgacttcaggagtgctgccatttccggattttgcagaagcttcagaagaagttctttatcatcagcggagctttccgttgcggctggttgaaccggctcaggcgttgcctgtctgcctgagtagaacgcagcttccattctttcagcgttcagtctgcggtcatcgtcgatgatatgggagtaaacatccgctaccatcttgacctgtgcatgaccggaatcgccttgaacggatttcatatcgccgccgttcagcttcagcttgtaagtgatactggaatgtcggagactatggaaaaccactttcggcagtcccttctcctcaatcagcttattgaaagcacggttgataacctgcccctcaatcggcttgccattggaagaacagaaaaccagattgaagtctacgaactcgtcaccgaaaaggtctttcagttcttcgatgtcagcctttcgctgtaccaacatttccgctacggttttcggtaagaacaccttgcggacacttgttttggtcttaggagttttgagaaccaatgcggtatgcgtactggcgaaggtcggtgggaacttgaacatgatgtccttaccgtccagatctgccatcgcttcacgatttactctctgcaactccttttcaacgaagatgcttgcctgaccaagttcaatactggtgggggaaatgtcaatacagtcccaggtaagccccagaagctcgcccattcgcagggaacaggagaaggcaaggttaatagccagacgaagaatatcatcgtcacaggcttccagagccttctggagcacttctgctgtccagatatccctggtcttgtgttcttctttcggcagcgtagcgtgctccacagggtttctggtcatcaattcccacttgaccgcttgattgaaagcatttcgcaatgtcttgtgaacctctcggacagtatgcggagtcagatattctgtacgggcttttacatacttagaagaaaccgctttgacagaaagcaaatctcggtaatacttgtccatgattctcggcgtgacatcctccagcttcatatcaccgatgaggggacgaatatagtttgcaatcaggctctttctgctttcataggtagacatcgcccaggtgttcacaccatagattgacatatactcatccaaaagatcattgacggttttagcagaagggggaataaaggttccggactcctgctcatattcaacctgcaacttccttttctttgcttcggcattcgtttcaaaggtttcccacttctgacgcttgttgccgttctcatcggtgtatgtataaaccacagaatacttcttttttctcttaacgatagatgccatgtaatcagctcctttcctgtctatcttccgctaactggtagcgggtctgattgtgataccatttttcaaagctctctttggtagctcgcttatacctgccaaccttgataagctcaaaatcttcattggcaacgatatagtaaatggtctgacgatgtaccccaagcattcttgccatttccggcagaccgtaggtggatgccataatatctgcatccagttcctgatcctctaccgtgcggtaatcggtttgagaagcataccatctttcaaagctctcctttgtcactctgcgcttgcccaggacatcgaccacatcaaaatgccctttggcaaccagttcgtaagcagtcgcttctttcagcccaaggcgctgtccaagctcctccattgaatatgtagttttcttcaattcctcgccgggaggggttccatcgaccttctggtatttgaactgattggcataccattcttcaaagctgtcgatcatcaccctcatggtgttgccgacaagaatggttttgaagtaattcttcttaatgagccagtatgactccgttttaccaagaccgagcatcctgcccatttccagaacagacatactcgtgcgttttctcatttccgccatcgtacaacctcctatgtaaaaaatgtagccatgtgtttcttgtcatggctacattttatcgaactctcaatatgttttgaagtttgtcgccgggttgtacgacgcccttgacaaatcttacatttgatgatccaaccactcatcaaaactctttttggagattctgatactgccaccgatgcggacgctatggaaaactttctttttcacaaggttgtatgcgctggttctgctgatgcccagaatatcctgaatctcatcaaccgtataggttctcttatcaaactgaactgcgttagcagccatcgcttcttcggtgcgctgattcatggcagcgattctttcttcaaacatttatgttcactccttcgctctctttgctttatgttttggggaacgctttttcagctgttccattgccaggctgacagataaggctttctcaatcgctaccatttcacggggcgttaccttacctaagtaattatcaatcctgcttttatcaatggtacgaatctgttccagctgaacaacggacgcttctttgaatgcaggattgtcgtaaataacaaagtgcgtcggcatattcgctttcttatggattctggtggtgaccgttgccacaatcaatgtgggagcgtgtttattaccggtatcgttctgaatgacgataaccggacggatgccgccttgttccgacccaactaccgggtccagcttggcgcaataaatatcaccacggcaatatacccaattttctttcatcatgtgccatgacctcctttcgttggctatgtaataactgactgccagaaaggaatcaggcagtcagtccaaaagtctatgtgtcccatatttgccacgcacccctgggaaagagggcttacgccctcagggaatcaccgaacgactgattgcgaatcagttccataggaatctaacctctgccgggttctccgccagctccgtagagaagtatctttaatcctgttgctttcatggccgtattgggagcaacccaatatttacaagccagtattgatcgctggcatcgggagagagacaagcgcttaatttatagaagaaagtcgttctgtttctctatccgatacgtctcggcgtaccgctgatgtggctgatgctctcgcaccggcaacaggaacgtattcgatgactgtgtattcagttttcaaggatcaagcagccgattttctttggctgtatctaaattgtacctgttcctcatgcaagtttttattgcctcgtaggtatagttttgaggttattcacgacctaaaaatatgtaatcaagggttgtctcaaagcgcacaaccagttcgattgccaaatcaatagagatacctctgttgccggtttcaattcgtgcaatggtgtttgcggcaacacctaactgctccgcaagctgttcctgtgtaagcccatgttcctttctcaaggctttaattctttttccgctttcaaccaagtcgtaatacattttcgttcctccgtgtttttgaatttgtgaagttgcaaaatcaaaaacagcgggaggagatcgtgcccgattctcaataccctttgccatctgcctgtcctccttgcaggcataaaaaaagagccggagtaaattactccaagctctcgttcatgcctttgtgttaattatgggggaaaataggcaggtataaaaaaagccccgtacccattacaggcacgaggcgtaactctctctattcaattttatgccgctatctcccagcatagccattttaacactggacaagtcggactttcagtaggggaaccgtcgtattttcatcggattttagtcggactaaaatcctgtcttagcattcacaataacacaatgcttcttcctcccgggcactttccaggaaatctttcaatttaggaatggctgttccccaaagtgacagaccaaataacagtatcgcttctttctttcggtcatagtaggtgctgcgttccatattcaaaacctccagcatttctgattccctgtacttgaagcggttgagatatgcctttgagataatctcacagtacagagcgcctttatctggatattctctgattttcaacatagccatatctaccagttcaatgatccactttgtctcaaataagctgcgaatgcgttcttcaaatcgttctctcgcttcatccggagcaaagttctccagataaatcaatgcaccatctaagctgtcaccgtaagtacaaataagggtatcacatacatcattcgcacgatcaatggtagaccagcacacctctcgatatatggataaaatcagctttgctctttcatacagaaccttctcgtcaatgttctgcatccggcaaagcattcgaatactgcttaatacctgtgtattatatctgctcattcagaatctcctttcagcctaatccataaaataagaattcctttctaactcctgtcacttggctaaagggaaacaaataccatgggacaagaatgactataacttccgatatttgattaaaataacagaagtgaaatcggaagttcttgactttataaaagttccgatatataattaagtggaattaaaacttctgttatgattcttattatagcattttccagaagtttgtcaacaaataatcggaagttacgaataaatattttttgaaaggaaggatactaccatgacatttggagaaaaaattaaagaagctcgtttggctatgaacctatctcaaacggagcttgcccagatgaccggcatttccgaaagatccctttacacctatgagcagctcggaacactccccagaaaaagcaacatcagaaaacttgctgaagcactgcatatctctgtgtcctatcttttggacgaatctgaaacggatagccagagccatatagatcaggatatgtttattttagaggcaaaggaaaacttcggttcaaaaggagcaaaagaagctcaggaagtgttgggtcgtgtaaattctctgtttgccggtggagaattggacgaggacgcaaaagatgtattcttccaggcgattatgtcagtttatatggactctaagaaaacagcacgggaaaagtacactccgaagaaatacagaaagcataaagataaagagtaaaatcctcaagcacagaatatgttttctgtgtgcgattcggaggtgaagcaaatgaaaacggcagagcatatcattgaaactgtcgataagcttgtgcgaaaatatcacaccagagacccttacgagctatgtcagctgttaggtatcaaaatccactattacgatttacagaagaaattgaagggcttcttctattaccagtccagacaaaagaatatcgtgatagatcacaatgtgaacggtatcctggagcgtatattagtcgcacatgaattaggacacgctgtcctgcatacaaaaatcgctatgatgcacggctttcaagaaatggaagtttttgatgatagatcaatcgaagaaaatgaagcaaacttctttgcggcggagcttctgttagaagatgggaaagtcctggaatgcctttcggaacacacattttttgaaacggctaaaatgctctatgtaccggcagcattattagactacaaattcagcctgctccacgaaaaaggagagctggtaaattcgatgtatattcgtaaagcagatttcctgaaagaagatcttcatgcctacgataacgacattggttatggcgatatatgaatatctatttttatatctttacagaaaaagtccaccagtacgatgcgtagtgcatcatgactggtggactttttgcttcttaaagaatcagtatattgtgctgcaaaaaagaaccccatagcagttcactctgtaccgtcaatgggcttctttttcattatatcaatcaagctccgctttttttatcatctcttgctggtcaatcaagacatcaatcaactttcctacggttatcaatgttgttacattacactttttcagttttgcagcaatctcattatcaatgatgctgtcgcattttgcatatggggtatccagtaaaaaatagtcaaagttcttttccaagacgaatgccagttttagaagcattgccaaagaaactttcgtctgtccaacttcaacatggctcatatgattgttcgagcaaccaaccaacgcacccaaatcagcctgactataacccttttccagtcgggcagctctaatgcgctgaccaatcttaacgtaatcaatttccggttgcgtttcaatcacctccatgctgtgtatgattctgctatacattataaaatgtaccaaaaatctcaacaaccaacatcgggtgcaagttgcatttataaatgcaatatgataaaattttataggcagattgcattaaatgatagaatgaaaagaaccccaagacgacaatatgagctatcttgaggttctttaaaataaaaaattcgtagagtacattactccacgaatcgcattcttctctgttttttttagtttatatctttattttacaaattgtcgcactgtttgtcaatatgttagggacataaaacacgaggttttgcacaaaaatccatcttagaaagttccaaagtcacaatttgccgtcagaattatagtcatattgaaggaggtgtaccttatggcacgaaaaggagaaaatatttacaaaaggaaagacggcagatgggaaggaagatacattaagtcccgatcttctacaggcaaagccaattacggttatgtttatgcaaagtcatatcgagaagtcaaggcaaaacttatcagtcaaagttcgtgcacgagtaattctgtcactgtcgatccagaaattagctcagatcaatttgaacaggttgctatggaatggtttcaagctatatgtcctaaagtgaaggaatctacaagcaacaaatataggaatcttctcagctcgtatatacttcctgtgttcggaagcaaacaattgcgtgatataacacacgagtttattgaaacgcagtgtaattttttccttgtttctggtggattaaaggagaatggactttcctctaaaactgtttcagatattttatctctaattcgaaatgtcttacaatttgccacccgaaacgggaaagccatttcttgtgacgcacgatctatacagataaaacgtcaaacgaaggaaatgagagttttgagtcgtgctgaacaggaaaaattatgccaatacttgtattctaatcttgattcctgcaatattggtatattagtatgtttattcactggtctcagagtaggtgaaatttgtgcgttacgatgggaagatgtttcattctcagattacacaatccacgtgcatcaaacgctccagagaatccaagatagaaccaacagtgaatacaagacaaggattgttgttaccacaccaaaaagtgcttgctccatccgtactattccagtaccccatggcttaatgactattcttacagcacacaaagcttcttctactggctacatcctaaccaatagcgatcagaatccattagaaccaagaaccatgcaaaatcattttaagaaggtattgaaaaacagcggaatcacctccgcaaattatcactcgttacgtcatacatttgctacaaggtgcatagagcttggattcgatgtaaaaagtctcagcgaaatattgggtcatgccagcgtgaatattacaatgaatcgctatgtacacccatccatggatttaaaaagagaaaatatgcaacggctttctgatttattagccgtcaaataaattgtcaacaccgtcaaataatgctgagttttcagtgtttggcggtgttttttcgtggagtaatgtactctacgaaagagtatacccaggaggagatttattgattcaatttgtagggcgagatgcttataagcagttttggaattttagtaaagatgagaaagagaacttggccactcaattggcgattgagttacccgcactcagaggaaaagttggtgcatcacaagaagaaattgcttcggctgttggtatttcacgacaaacttatagtgcctacgaaaatcggacacgcccaattccatggagtttatatctagcactattgttttattttgattacattccaagtacacattatatgattcgccagcttgaattattcccaaatgaaagaagttatggaaataagacttagaagcaaacttaagagtgtgttgatagtgcagtatcttaaaattttgtataataggaattgaagttaaattagatgctaaaaatttgtaattaagaaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggagtattccttaccatttaagcacacaaattattaaaaaagtggtttttgaaagccatgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataattctatgagtcgcttttgtaaatttggaaagttacacgttactaaagggaatgtagataaattattaggtatactactgacagcttccaaggagctaaagaggtccctagcgcctacggggaatttgtatcgataaggggtacaaattcccactaagcgctcgggaccccttgtaggaaaatgtcctaagtgtggcaacaatattgtattaaaaaaatcgttttatggttgttcaaattatcctgaatgtaccttcactttagctgaacattttagaaagaaaaaactcaccaaaacaaatgtaaaagaattactagagggaaaagaaaccctggtaaaaggaatcaaaacgaaagatagaaagtcctacaatgccgttgtaaaaatcggagaaaagggatatattgattttatctctttttcaaaataagcataaaagccctttaaagagggcttttatatattaatcacaaatcacttatcacaaatcacaagtgattaatcacaaatcacttgtgatttgtgattcctaatgatacaatattactatacaaaaaaagaatggggcgtagttatggagaaggaagaactcaaaatacttgaagaattaagacgtattttaaacagtaaaaatgaagcgattgttatcttaaacaattattttaaaggtggtgttggaaagtcaaaattatcgactatgtttgcttacttgacagacaaatttaatttaaaagttttaatgatcgataaggacttacaagcaacattgacaaaagacttagcaaaaacatttaaggtagaattgccacgtgttaatttttatgaaggactgaaaaatggaaacttggcttcttctattgttcatttgactgataatttagacttgatccctggcacgtttgatttgatgttactgccaaaattaactcgctcatggacttttgaaaatgaaagtagattgcttgctactcttttagcacctttaaaaagtgactatgatctcattattattgatactgtaccaacgccaagcgtttatacaaataatgcaatcgtggcaagtgattacgttatgatccctttacaagcagaagaagaaagtacaaacaacattcaaaactatatttcctatttgattgatttacaagaacagtttaaccctggactagatatgatcggttttgttccttatttagttgatacggacagcgcaacgataaaatcaaacctggaagaactgtacaagcaacataaagaagataacttggttttccaaaatattatcaagcgaagtaataaagtaagtacctggtctaaaaacggaattacagaacacaaaggctatgacaaaaaagttttatccatgtatgagaacgtattttttgaaatgcttgagcgaatcattcaattagaaaacgaaaaagaatagaatcacaaatcacaagtgattaatcacaaatcacttgtgatttgtgattgttgatgataaaataagaataagaagaaatagaaagaagtgagtgattgtgggaaatttaggcgcacaaaaagcaaaacgaaatgatacaccaatcagtgcaaaaaaagatataatgggagataagacggttcgtgttcgtgctgacttgcaccatatcataaaaatcgaaacagcaaagaatggcggaaacgtaaaagaagttatggatcaagccttagaagaatatatacggaaatatttacctgacaaactttaaaaggagtgaaaatgaaatggcagttacgtatgaaaaaacatttgaaatagagatcattaacgaattatcggcaagcgtttataatcgagtattaaactatgttttgaaccatgaattaaataaaaatgactctcaattattggaagtcaatttattaaaccaattaaagcttgcaaaacgtgtaaatctttttgattattctttagaagaattacaagccgttcatgagtattggcggtcaatgaatcgttactcaaaacaagttttgaataaagagaaagtggcttaatatggcaaatatagtcaattttactgacaaacagtttgagaatcgcttaaatgataatttagaagaattggttcaagtaaaaaagcggttgaatcgccaaccgcttttttacttggtgggcaatcagggtcagggaaaaccagtttgcgaagaagatgattgagcaggcaggaacaaagtgataaattcaaattgtgagggaaaatacagatgaatcaaggaagaattattgtgattacaggctcaccggggacaggaaaaacaacaactgcgtcaattgtcgcaaaggaatcagatatggataaatcagtgcatatgcacaccgatgacttttttcattacttaagcaaaggcgcaataccaccacatttgccagaatccaacaagcaaaatctggttgtcattgaagcctttttagaagctgcaaagcgatatgctcgtggcggatatgatgtaattgtagatgggattgtcgggccatggtttttggagccatggaaagctcttgcccaagaagattacgaggtacactatattgtattaagagcgagtaaaaaagaaactatgaagcgagctgtggaacgctcaaaattagatagaaaaacaaatattgaattagtggaaacaatgtgggagcaattttccggtttggggatatatgaatcaaatgtcatagacacaactacattcacaattaaagatacggtttccgcaataaaagaaagagttgcatgtgggacgtctttactatcttagacattcccatttgtcaggaagatagcaaagccagccgagccagtcaacggtcaagatgaacggcgcatttcatgcgccgccgttgacagtcacgcccgtctttgctaaaaagtaatcaaggcgggaaagccctaaaatggcttcccgcccatttcaatttttagaaaagaaacgctccaaaatcagaaagagagcgtccaagcactttgagggattggccgccttgtccacccattcagcgggacagcgggcggaggtcaaggccgggtgtaaacccgttcatttcagcttagaaacccttcataaaacgggcttatttagcgatataaggctttataatagagaaggagtgaaacttctattcaagtttagaaacgccttccattagtccgaaagagaccttagaaagagaattaaatcgtaaagtatcagggaaagaaattcaaccgactttggagagaatagagcaaaaaatggttcaaaatcaacaccaagaaacccctgaatttaaagcaattcaacaaaaattggaaagcttgcagctacctacaccaccaatacccaaaacacctaaacttccaggactttaaaccttaaaaaaggaaaagagtagttaccaaaaaacggtaactactctttttttataaaaacctttcctcatgtttgaaaagctgatcgagaaataaagcacacaacggtattctttcttttttcagttggtacattttgcagtctgtaacgtgtcatttactgtttgttaccttaacatatccagtcgaaaacacaagggtatataaacgagcaagctcgcccttgtgttttctttgtgtctatgttgcgttctcgtcacagcaaacgacacgaacacactggcgaaaatgaaccaacaaaacgaaaaaagaaaggagcgtatacttcacagacggtgttaaggatacttaccagatgaaaccgtacattgcaccgaccgctgctgagttggaacaatttctttcctctctaaattaaatcttgccgaagcagtgatgtgtcagactttcctgacacatcgccgctttgcacttcacaaaatccgctgccaggaggtgatgaaatgagtatggtaaatgctgactccgttcagctattcgcaatgctgaaaaaaatgcaggattccatttcctccatcgaaactaccaaaaaatctgtaaagatgaaatatgaacagttaggtgctggatggcaagataaaaaatacaacgagttgggcgtggttgtaagagactgcaacaaggctctcaatgacatattggtaattatgcttcaagcagaaaaatatgtggctttactcgccaagagccttagtgaatacgaaagtgttcaactaggatctacaaatggaatatctgcaagcacacctcagaccagtagttttgctgttacaccatcaagtgcagatacaaccacctttgagtcaaatacctttggttctaatcttgcatttgttcaagacagactatcagctgaacgatatttttcccgtggaaatcactatgaagaatatcgagattattgggagaacgggaactataccttttctcgaaatgaaaatccagaactcgtatacgttagagcaagggatattgaaggagtttatctcagtgaccgagaacttgggaacccggaaggattttggacacggaatggtcgagagggatggtcgagagaaaacattctaaggcgagcttcgcacatccaagatgttcgtcaaaatactgagtcaggaatgtctttggatgagctttcacaaaacccagtgttagatgataccattcgtagctattacaataatcctgtccaggttgcgcaggtaggttcttattatgtatttcagagtgatgggcgacatcgaacacttgcagctcaatcgcttgatacatatatcccggttttagtaacaggtagctacactcgaaatgattaacaaatgaggaggtgagtgtttgagcaacgtaaatgctgatgcaactcaattactgacaatactgaaaaatatgcggacctccatttcttctatcgaaactacaagaagttctgtgaagatgaaatatcagcaattgggaattggatggaatgacaagaagtacgatgagctgggaactatcgtaaaagattgcaacaaagccctgaatgatattttacagattatgcttcaggccgaaaaatacgttgcttcacttgccaaaagtgtacaagaatatgataatgttaatttggacactccttctgcacgaaattctttcctccagggtctgcaaacacctaatgttggtaattcgtcttatcagtattgccttggcgtgctaacccaaggtagcacaccagacggatatatcgctgttatatcacaacgccatgaaaatgcagagcagaatgtcagagaagtgtttgaccatttcgctggtaaactgatgatacaagattctgaatatccaccggatcagacagcacattactcaccgggaaattatatagggcattcacgaggagtctactacaatgcagcttctgatatgacaaatccaagaggtgcaggaacaacttatttccacgagcttgctcacatgatcgaccatgcttcgtgcaactatcggagcaatctatccaatactccagaatttgctgaggcactggttgaggacggacaaagaatcctgagcttatataacaatcttccagtggaaaagcaaactgcttttctgacccgtattaggcaggattcagctcactccttctcggacttaattgatgcgacaacaaatggtcaattgcacggaaattatggtcactcaaggaactattggacgagaccgggcaatctacaagcagaagcctttgcccacttttttgaagcgtctatgggagaccaaggcaaattagagctattagcaaatttctttcctacagcgtttggtattttttcttcaatgattgattctattagaccagataatcatgttagggtcttgagcagagaaaggtaggtgcatacaatggacaaaaacaagagcgttgcagattttatgaatagcttccttaatacacctgaaccgaaaattgataatgagtattatgaaatcgaagaacagtattttcggcaattcggtcatggtgtcccaagggaaatgttgcctgatagcatttcaacggaacaaattaaacaagccatgaaaaaatgcattctttccaaaaaggataatctctttgaactattaggcatcattatcaacgataattatttatattaagaaaaggaacgacgacatggatgaagacaacattataactttgaatgatgagaatgggaacgaagttgaatttgaatttcttgacttaataccgtatcgccagaacgaatatgttgtcctgcttcctattggagattcggatgggcaagttgttattttgcagctgaaagaaattgacgatgaaacagaagaatatgttggtgttgaaaacgaatttgtgttagagactgtctttgctctgttcaaagagcgaaacaaagatttctttacatttgagtaattaaacaatgcaagctcaaaccaacaacacgataaaaggggggtgcattatggatatttggcatcgtgtaggcagaattgttcgcttctcaaacttaggaactcttctgttctttactcttaatattctgctgattgttgctgtgttcggttcgtcaggaagcattgttgaactgatttgtatttactttttcacagtagctatcagcttatccccattaggcgaaatgtgcctggctgccttcgcaggagcaagcgatataaaaagagtagatataaaacttcgagttgtcccgctggttcaatatgttttagataaagcaaaagagaacacatcatactgtcctaaaaaagtgaaagtgaagattatccatgatcctgctccaaatgcatttgctctaggtaggcaaacactatgcataactgacggattgcttttactctccgatgatatgatacttggaattctcgcccatgagatcggacatctctcatacggacatactgttatccaattattgattggcgggggcaatatatttatatccgggtgcctcctgttaatcaaaatatcctactggattttttctgcaatcatggggctgttcgcaatatgctctcgtagtggtgtaatgggtataattaccgcagttttcgcaggaatatcaacagcactttcttggttatgggtaaagttctgtatgctttttctgatgtggtctatgagacaaaatgagtatctggctgatgaatttgcttataaaattggttttggtcttgaattagcgacggtattagaccaacatatctcagatgttccgcatgatggttttctcagtgcaatatactcaactcatccatgcaacgatgatagggttgcagcattgcaaaatttaggtgtaccctattctcgatactaaattcataatctcacaaattggcaagcagtgtaaacctgtacaggttcactcattttctcgattttcccttcggtgcaatcttcgcaaatttgcttgttggggaagcatccccaatcccctttgaacatcatctgccgatgatggctacacgattttcaatcgtttctcaaagaacagtagaataaaaatttgcccatggttgaaagcaccgaaatcgaaaagcaaaaaagcagccacgatccgcaccctttggggagtgcagaccgtggctttttgctttaacggaagttcttcttttcctctttctctttctctttttcctgctctttctgcctgtcgatattcaaaatcgtttcaaccgtccgtttggcaatcagcagttcttctttctcttttctgatctgacggtactcagcgtagtcctgctttttctggactgccagctgatgaaactcctcatacaatgattgcatggacgggagctttgtaatctgcaattcagcaaaggcttgcttcgccgctttatgaattgtgatttcctgacggtgttcttcaaagaattttttgctatatccagacttgcggtactcgatataaatttgccttgtgttgcgataatttttgatgtgctgctgcaacgcctgaacctcaaccatacgtttctctgcgaccttgatagaatcagaaagcgcatcgaaccgggcagacagattttcaatatgagcagtcagatcgtcgtagttgcccaagcctttttctttcagtaggattaccgttcgggcagcttcttttcggttgaacttcttcgcccacttttcataaccgaccgtcttgccctcggccatctttgcctgaatatcaatcagcatctggaactgcttcggggcaggagccttggcagagccgccttttgatttgtgcaggttcttgccggagataaccgcttgaatttcctctttgctatatccttcgcccagggaacgcagccgaatgaaacgcttctgattctcgcccttgaacgcaggctgctttccatccttgaactcaaatcccatgtcagccagagcctgaacaaagccatcaaagctctttggtttctgcttcagcaccgcatcaatcgcatcacataattcgtcacgctgggtacgcttcttgggataaacagttcttttctggcgctcccgatacggcttcggtgtaataatggacagcccgtgttccaggcaaaccatatcactgagtctttgcaccgccagaccggaaagaaagaagtttttgaatttccgtgtggcatccagcgaggtcgaattataaatgatatgattgtgaatgtgggatttgtcgatgtgggtcgcaacgatgaaagcgtgttttccctttgtccatcgcatcgctgtttcatagccgacttggttcgcttcttccggggtgatttctcccggcttaaaggactggcgtatctggtatgcgatgatattgttcttctgctgtctgccggtaatatgctgatactgccgtttggaaagcagaaattcctcatctgctgtctttggatcacactcataggaactgataaattcgccatcattggtttttgcggcattttgtgagtagtcggttctgtctgccaaacattgagcgaccgtctttcccttattcacatggagtgcaatcaatcttgtcgctgccattcccatcacttccttcccaaaaagaaaaagccaccggtcggtgacttttctctgatattatcttatgacctgataaatgctcccagactttctccaatattctcgactttcataacagcccagacgagcaagaacaccgctgctattgtcgcaattccaagaaccacaagaataagcagggactgccacaaagcctttacaatgcagtaaatcgcagatccgccaatgaccaagagcaataaaccaattacataggacacaacatttgtaagcagatttccaagaatgcaaatcacttttacaacgaacagcaccggcagtgccaatatcttcaataccagcttcataggctcaacccctttcttttaattatattgtacaagggtatctgccataacgcaatgatgtcaacccttatgtaaaagccgcagccgaaactgcgacttcccaacaagttgtcggattactggattgaggacaggcgaacaagaacttctctcatgtccgtccagatctcctccagccgtttttgcaaatcctcaatgtcagcacgatagatgctgcctgtttcgttcgctcgctttgcgtactggttcaggttgttggagcagattcgcaggagcgaaaccagggctttcacatcctgcaaatccagtctgatacagtaaccatccagagccattttccgcagataggctcccatgctgcggatgccaagctcgtccatcttctcatggattcgctcgacctcctccttggatgcaaggaaatgaacatcctgatctcgctttgccattacaacacctcctcacgggtttcagagtattttgcaggcgggatatgctccgctttggatttcagatcagccaacacagaaggacgctctgactcgcttctttcgtcacgattttccacagagtcctccatattcagggctgcatccagttctgccagtcgctgacttttggctgtcagctctgcttcctgcgggaacggttttccaacctccgccttggctgcttcctgctgattgtagagattattcaactgctcattggctcgttctaagcgctcaaggatgcctgcaagggcattgtccagtcgggtgatatttcctcgtgcgtccgttccaagggctactctgtggctcacagcgcccttcagggtcacatcgaactcgttccggaaactgtcaaacgaaagctccatctgaaagccacggtaactgccaagaggaaccggatcggcacttttcgtgtccttacaagccgcaaggaggatttcaccggcatctgccttttcggtgtaggctttgcccatgatttccatgccgcaaaagccatcggcaatctgcgggtgtgcttccacggttttaatatcagcttcaaagccatgaatatagcctgtctgcttttcaatctcagccgggaagtatttcagaagcttatcttccatacggtactgctggctctggtggtcagctttcagcaccttcagccttgccacatcaatgtccaagtccatcttttccttgataagcggattgccggcacacagcgccttgatctccgcataggacagcgcctgctcatccacatcgtcacaggagcgaaccggtgatttggaggtcataatctgagaaataaacttctgcttgttttccaaggtctgatacaggtaggcatcgaaggttccctcggtcacatactgatacacctgaacctctttgttccggttgccctgacggatgatacgaccgtttctctgggtcatatcagacggacgccaacccacatccaagtggtgaactgccaccaatttgtcctggacgttggttcctgcacccatcttttgcgtactgccaagaagcactcgcacctgcccggtacgaaccttggcaaagaggtcttttttctttgcctcggtatctgcatcatggataaaggcaacttcttccgcaggcacaccgtttgcaatcagcttggttttgacatcatcatagacattgaaggttccatcatttttcggtgtgctaaggtcgcagaacaccaactgggtcaatttgtcagcctgaccgtcctgccagatacgcaggatatttcccacgcaggcattgagcttgctgtcagggtcatcgggtaacagggtgttcattagccgctgatccagtcccaattttcgtccgtcgctggtaatcttgagcatattatcgacggacgggtctacaataccggcatgaacatctgctgctctctctgaaagggaagccaccatatccttctggtactcagagggctgaaccacaaccgtttcaaactttgcttcgggaacagggagatgcaactggtcagaggtcttgatgtcggcaacctccttgaacatattcatcagttcaggcaggttgaagaacttcgcaaatcgggttctggcacgatagccggttccctccggtgcaagctcaatcgcagttgttgtttctccgaaggtcgatgcccaggaatcaaaatgggtcaggttcttttgctggagcgtactgtactggagatagcgcatgaccgtataaagctcggtcatcgagttacttactggagtaccggttgcaaagatcacaccacgcccgccggtcagctcatccatatagcggcacttcataaacatatccgaagatttctgggcttcggaggtggacagacctgccacatttcgcatttttgtgtagaggaacaaattcttgaacgcatggctttcgtccacaaacagccggtctacacccaactgctcaaaggtaatgacatcatctttcttgtcagcggcaaggagcttgtccagtctggcttccaatgattttcgtgttttctccatctgcttgatcgtgaagttttcgccacgctgccatttcagctccgcaatcgcaccctcgatctcatcaatctgctcccgcagctgccgttcctgtcgttcggcagaaagcgggattttttcaaactggctgtgaccgatgatgactgcatcatagtcacccgttgcgatacgagcgcagaacttcttacggtttgctgtttcaaaatccttcttggtggcaacaaggagcttggcactcggatagaggtgcaggaactcgtttgcccactgtaaggtcaagtgattcggcacaacgaacagggatttctggctcaatccaagccgtttactctccatagccgatgcagccatctcgaaggtcttgcccgcaccaacttcgtgtgcaagcagcgtatttccaccatatagcacatgagcgatagcatttctctggtgttcacggagggtaatatccgggttcatgccgccgaaacggatatgagagccatcatactcacgaggtctggtggagttaaaaagttcgttgtacttggtggaaagggtttctcgtctgtgcggatctctccaaatccaatctcggaacgcatccttgattgcctgctgtttctgctgtgccagggtagtttcttttttattgaggacacgcttctgcttaccatctgcatcttcaatcgtatcatagatacgaatatccttcagattcagcgtttcctccagaatccgatatgcgttggctcgctctgtaccgtaggtgacatacgccgccacatcgttgtagttgggagaactcttaccgttgatgcgccactctgcggtcagctcggagaacttgacctcaatggaacggcgcaagtaatacggcgtttcaaaggtttcctccatgaactgctgaatataatcggcatcaatccatgttgcacccaaacgcacatcaatctcggacgcatccaagtccttcggctgtgctttctgcaaggcttccacattgatgtggaaggaagaatccctgtctgccgccatctgtgcgacacgcagcttgcttcttacatcaccggaaaggtaatcatcggcagtctgccatccaacttccacagcatcgggagccatcgggtctttgaagatcacccctcgaagctctgcctgaatcgcatcgtattctccaggtgttccaagcagctgtgccataaacggcaaatccaccttgccacgctcaccgatagagattgccagagcttcggacggcgtatccacgctcgtcactctgcgttccggcttgatggttcgcttggtgaacatatccgccttgcttttcagattgccgtcctcatccacattttccagagaacacaggagatagtaggaggaatcgtcagcaaatgcctgaccattggctcgattattgataagcccgttctttgcggcaaacgcatcgtaggcatcattcagttctgcctgtttctgagtaatcatttcatccgggtaatcctcaagctgatattcgatcagctcgttgacgataccacgaagttccaccatgcccatcacacggtcttttgctttctcattcaggtctacacggcgcatcagggagttttcacggaagtacacattgccatccaccacggtataagagaaattctttacatccggggttgcaggaatggtttcgatttccttacccttgtcagcttcgggaagctccacagcctgataggttccttggatgtgggaaactgcttctttcagaagttcggacagttccatgccctcaatgggacgcactgtaatgtccatgccgtaggcggtactttcttccaccgtatcgcccagaaccatttcaggatgagcgacaaagtagctgttcatggtgtgtccttcttcggtgcggtcaaggtttacccattccggtacaatgtcaatcggatggtcacgcttttgcaggaacaggatgtcggacacgacttccgtgcctgcgtttttcttaaaggcatcgtttggcagacggattgcaccaagcagttccgccctctgcgccatatatcgccttgcgtcagagttcttggaatccatggtgtaacggcttgtcacaaaagcgaccacaccaccgggacgaacctgatccaaagccttggcaaagaaatagttgtgaatggagaatcccagcttgtcatacggcttgtcggacactttgtagttgccgaaagggacattacccacagccagatcgtaaaagtctcggcggtctgtcgtttcaaaaccggctactttgatttctgcgttgggatagagcttctgagcaattctgccggtgatggaatccagttccacaccatacaaacggctgctctgcatttcaggagggagcataccaaagaagttgccgatacccatagcaggctccagaatatttcctgtttcaaagcccatctgtccgaccgcatcgtagatggagcgaatgaccgtagggctggtgtaatgtgcgttcagggtggaagctcttgccgcagcatattcatcttcggaaagcaggtttttcagtgtctgatactccttcgcccaatttcccttgtccgggtcaaaggcatctgccagaccgccccaaccgacataattcgacaaaatctcctgttcttcggtagtggcgttcctgttctcgctttccagtttgaacagagtttcaatggctgcgatgtttcttgcgaatttctgcttcggtccaccttcaccgatgttgtcatccgtgatgtggaagttcaccgcaggaacaggtgggatttctctggtggtgatggactgctcaagctgagcgataatgtccatgacttcggcattctgccatccgtccacctgggcataatcctgaatgatggtgtcctttccatctacgcactgtacgaagtccagactacccggcagatctctggtattcattgcacccagggcttttctctgcgtgtcaggaagtgcatagtaggctcgcagggcatcatcaaaggaactgtattccttgatgtccagcgcaccccgcttctgaatgtcctcggcaacataaaaatgatcgatgaagtgttccggttcctgctgttcgggttccgcactggctctgacctgtgcgtgtgccttttcgtcagggtagtccccatagatacggatgcacttatgctcctgctgatcgtaaacggcagcaccatcgtacttgaatccgtcatcctccatggttccgtccacatagccctgggcagctttttccgcttcttccagagtgtagtagtccagtttatcatcgaagccgttttcaaagtgatggtaggcggcaaccagatagcggggagccatgcgctcctcgtagctgttaatcatctcaggtgtcagccattctggtttgtcgggaatcatttcatacagctcacgcatcttggcaatctgtgcatggcggttgcctgcccacagatgcttttcgctgtgctgtcctgcaccaaggaagtattcgcagtccatacgcagacggtctaacagctgatactcaggggtgtagtccctcggttcggttttgcccagaaaatcctctgtaacgggcttttcttcggtttgggcatcaacccttaccgcatggtttctttcgtcctgagagagcatacgctcgaaattctcacgattctcggcacggaagatgggataagcaagcgtagggtcacgcagctgaacttctctgtccgtgatctgctccacacggaaagctgtatcgtccagatataccgtgtcaccgacctgataattccatttcggttcctcggaagcagatgcttccacaacttcggcaggctctgccacaggcgcttctggctgaaccgactccatcgcagctacggactgacgaacttcctccaaatagtcattggcaagccattcgtccgtgaagtattccgtaacgccttccgggtctacatagtagtcatcggtctgattatcccagatcgcatactcgccatcctcggtatcaatcactgcgaaacggtcataaacatcttccaacggatcagttttagcttcttcgatagcctgtcgttccgcttcttcctccgggctgaggtagcgtccctttcgtatcagaccgtcgattctctgcaccacctgcgcccaggacatctgcaatttatcgcaaccgctcttggtgtaagcaacacccttggcatcgtgatcctgaccgctgtgcgttgcaccagagcaggcatgggaatgaccaccggttccgtattcatgcttcaggaagtccatcttttccttggcagaatgattctcctgccagtagttataaatacgggctttaccaccggaaaagccgcttccacgggtcaagtctgcattgacttcatcatccgtaatgaactggcggacaaggggcatctgcatcatatcggtctgatactcacgcaaaggcatattcaactcatacagctgtttctgaatgagattcagcttgtgatagtgaaaacgaagcagatcgggattttccgcaagggtttttctaaattccgaatactgctgtaccaaggttgcgtggaaacgagggtcatccaacttttcagccaagtctgcggtttcgtcagggaaaccacgaaacggttcctgatgaagaattgccagatagttgctggaacgggcttcttcactcaaatcgtgataaagatgccacagggattctgccaacttctgacgctcatatccggatgcttctaccagttccacattagttgcgaaccgaccattttcaagcagttctccaatgcgctcggcaaccgtttcccaagaaacgatctgcgctctggggctgtcaatggcagaggaacctttggcaaggtggataccgtcctcggcataccacgcacagatattcccgctatcttctttcagaccatagccgccgtgatagacctgctttaaggtctgaacgatttcttccaacggcttctgcttcatatattccagcgctacgacttttcgggcttcatcggtattgctaccaagcagaaggaagtggtcgatttcttcctgggcaaaagaaaaagcagagggcgtaaagctctctgctcggtcgataaaactgatttgttcattttcggagaggaaaaggttcagactcagctgttgataagctccgtcatcacgacttcctccgcctgtgctttcaggctgttcatgtgctgcacccacgccatctgctgcgtttccttgtccggtgcggggctgtccttcaggtactgctccatcagaaactccactctggctttcgctgtttcctcgatctcccacaggtgcgggaacaggctctccgtcagaatcatgtcgttcaggagcatcggattgttctgttccaaaaatgctcgacgcatcctgccgtacttgcccagaggtttctctccctcgttctccaactgaaggttcggaatctgataatctccggcctgtctgtaagtcatctcgctcataatctgtactcctttcggtagctttaatctgctcatgttctccaatcgctttttcgatttcctgaaacatccttgtgctgatggcattcaccgcagtaccaagggcatttaccgtctgtctggtgttaaaatcaaacaccttctggaaatcctcatgctcgaagtagttgtcgggactttccacgaaccggcaatacatcgtataggatacgctgtttgccaccgcatttttgaaagctacttcgatgttgagttcatcatactcctcaaggaagctgttggcaacgatgtcgaggaactgctttttgtaatcgtcccaatactcagccgccagtgcggatgcaatatcttcaagctgtgcttccagtaccccgtcagcggcaacaccgaaggtacgctccatcgcttccatgacataggagcggttttcaggcgtcacctcccacggtttcagttccggggaagaacggcgaacgccggtatccgccacatcaaacacatagcgcagatacggtttatccctgttcatcacaaacagagcaatgccggtagagccacgctttacatatctgcggtaattttcagcgttccagtcctcatagggcttgcaaaaggtcgcattggggcgctgagcataaatcatcacctgttccggataggtgaactcatagttgcgggacatcgttctcaaaaacgaagtccagttatctgtgttcgaggtgattttcccaatcgtttcttttgctaatccggaataaaatcgctcttttgcgttcattgtatccctccaatcctatcaatccggataaaggttcagcttctcaaaggcggcatcgtccatggctgaaactttacggagaaccgagtctgccaaagcaaaaagctctgactcgtcctccgaaagctgttccttcatcagtgtcagtgcttcacacagccctgaccttgtgccagggctgtaaagcatcatcatgttccgctcatcctgtgtgaaatccatcattcaatctccctttccgggtggctcttgggcggcttatgggaaacatccggcacgggcttttcctttaactgctccaacaccgaaggacgttcctctaatccggacgcttttccgttattgatgataccgtcaatcatcccataatcatcttccattgccatctctgcgtttttcaggtagttttcggacttcataaagttttccagcttctgaaacccaacagaatctacatagtgaaaggatacctcaccgactacctttaaggctacgatgtcgctgaccgacatactgtgaccacggaaatcatccgggtggtcaatattgaactttacatacaaatcttccagctgccgattcacatcctcggacatagaaatggagccatgatagaccacctcgtaacggtcaatctcaggctccatttctttcttctgaaggtagctgtaatttgcaaacatgagcgggatattatcgtctacatcttcccgcagctgaagaatcgcataggaatccgtggggctttccagaaaagcaaccattctgtcatccggggtggtatttccgtgaacatcatcccatttttcgtttttcatatccgtgtcctccttatcgttcaggctctttgcgtttgggagagggactggcaggcgcagctttttctgcggcctgtgccagtttttccatgaccgactcacgcttcggagagtcgagcttatccagctgacttttcagcactttggcaacctcaaccgcagtttcctcacgggcttcttcaatggctgtattcaggaactcacgatacggagccgtattaccagcggcaagatctgccttgatttcttggatatgcgcctgcacatcatcgacctgatccatatattcataggggtcgaagttctctgcaaaacggtcgagcttaaaagcaagctcagcgatagggtcattgaccaccaccgcctgtctgccgacttcaaaagcctgctccatgacatcctcatagaacattgcccgcagttcccggcgctccagcccgaaggattccagaatatcccggcggacttcgagcatggacagttcagggttatcaacctgaccgccatcaatctcgttgtagttttcatccaacagggtgtagtcgtaaccatcttcgcaggtctgcaccgcaaggattctatcctttccgaccttccatgcggcttcatcgcccataatctcaggctccggcatatagcttgcgccgttgcgctccataatttctgcaaactggcagatatgaaacacattgtatccgatctgcgtatgatactcgtcaatgaaggtgcagggcttcacaaccatttcatccgggtagtgaatctgcacacagctgccatcggggatatgaaacaaatccttataatggctgtcgataaatcggatttccttaccatccgggttgtactcatttgtcatttgcgctttcctccattttcaaattccatactgaacttcgttttgccatcatctgatacctccataaagacggtggcatcaaaggtgttgcccgttctttcggacttgcaattcttgagctttaccttgccggaaccaagcaatttctgcgccgtggcagaagtcatgctcttgccgatgctcgcaaagtagcgattgtttttccagagggcaaatttgcaagctctgttggaacagaaaaatgccttggctttgtcctctacagcactgccgcagagcgggcatttgccgatagaattggcttctttcgacatcataacctcggaatcacggattacttcatagttctgaatcagaccggcaatcacatctttgatctcgtccataaagtcctcgctggcatattcgcctttctcaatgagcaacaatttttcttcccaatccgccgtcatggatggggactgaatctgttccggcatgactgttaccagagccgtacccttgtgggtcggaatcaggtgtttggttttcttatcacccttacgctccagaaaaccgatgcgaaccagcttctcaatgataccggcacgggtcgcaggcgttcccaaacctttgcgctccacctcatcaggcatttcgtccgcaccggcagtttccatagcagaaagcagagtatcctcggtaaagtgtttagggggagatgttttcccttccttgatttccgtgccgctgacggtcatttcgtcaccaacggaaacagaagggagtgtctgcacgttttcgtcggattttgtcgaatcatttttctgaaccagagctttccatccatcctgcacaacagttttgcctttggtggaaaacacggtaccgccacagtccagctcaataactgtctctgcgtatcggtgcggatcgccaacagctacgcacaaccgattcgagatcagttgcaaaattgcaagttcacccttgggaagttcgctcagattgcatttctgcaattctctggtcggaatgatggcatggtgatctgtgacctttttgttattcacaacctgctctgcatgaactggtatgttatccacatcctccacggggaatgtgtggaaagccagctttacgaggtcggtcaggctatgtgccatatcttccgtcagaaacctgctgtcggtacggggataagtgaccagtttcttttcatagaggttctgcgtgtagtccaaggtctgctgtgccgtgtagccaagcacacggttggcttctctctgtaaactggtcaggtcatagagcgcaggcggcttttctgttttctccttacattcagctttctgaacgattgccaccgaacagctttgtttgacagcttcggctgctgccttggttttgaagcgttcgcttgcagccgtaaaaccatccaatccaatctgaactgtgtagaacagttcaggcttgaatgcggaaatggcagcttctcgcataacagccatagcaagggtaggggtcataacacgaccaacattcagggtctgcccgtaaagggtcgaaaaaagtcgagtagcgttaataccaacaatccagtcggctcgttctcgacacagtgctgcttcatacaaagcatcatattccgttccagacctgagattttcaaagccctccttgattgctacatcttccatcgaggaaatccaaagccgctcaaacggctttctgcacccggctttgtggtacaccaaccgaaagatcagctcgccctcacgaccggcatctgttgcacacacaagactcgcaacatcttctctggccatgagctttttcagaatcccaaactgttttttcgtaccggcagaaacctcatactgccagtccatcgggaagataggaaggtctgcataagcccatttgctgtacttcgcatcatagacttccggctgtgccagctccaccaaatgccctacacaccagctgaccacatatccgtttccctctaagtagccatcctcacgcttggcagcacctaacactttggcaatactctgtgcaaccgaaggcttttcagccaaaactaatttcatttgcatctgctcctttcacaaaaaaataagcagccacacaccgtagtgcatgactgctatgtaaaaagttcggaaaggatttttgcaacctgatacaattttctgttctacaatctccgtcataataaaaatatctccatcatttcaaaagagaatgacggagatatttcaccttgcttattcttgtagcaaccaatcggctatatcgtgaatttcgattccttcatagctatattggggatgtttggttctggcaataatcattttcggataagcgtctcgaatctgaagcagaggagagcattctctctcaaatgtttcctgcccggaaatgttgtcgctgacctgaatataaatcttttcgctacctctctgagcaacaaagtcgatttccttttgatagagcttgccgacatagacatcatatccacggcgaagaagctcgatacaaacaacgttttcatatactctgccatagtctatatttctgcttcccagtattgcatatcgaataccgctgtcacacaaatagaacttttcagagctttcaaggtatttcttacctcggatgtcatatctcttaatatcataaaatacaaaagcattgcacaaatacttaatgtacttgccgacggttacatgattggttggagtctcatttgctgtcagtagctgactgaccttattcggagaagtcaggttgctgatattatccataaggaactcgctcagacgttgtaaaaccaaagtgtccgggagagtatatttctgtaccaaatcccttgtaacaatcgtttcgtagacctctttgatatagtttgttctgtctttttcggttctataagcataggaacctgctaaaccgcccttgatagcgtactcatcaaagagcttatctttgtcactaatatcatcataatactggcaatattcctggaagctgaaaggaaacacatgaatttcaatatagcgtccggtaaacagagttgccagatctgcactcaacaggaaagcattagagcctgttacatagatgtcgtattttcccttagagtacaggctattgattgccaactcaaacttgggacacatctgaacctcgtctacaaacaggtagttcgtttttccttcctgataatgttcttccacataggcgtgtaaggcatggtattccttgatttcttcatacgccaaatccatgaagtcgatgaagataatattgatgttttcaaaattgcttttcagatacgcaatatacgcctgcatcaatttggacttaccagatcgacgaatgcccgtgatgatcttgatgtcaggagtaccattcagttcaatgattctatcgagatattttgctctcgtgattgttttcatatagtcacccgctttcaaaaattgaagttttttcatttctcgaaaccgcttcgctgtacttattatactgtctgctaatagtatatgcaagatgtcactttcaaaaacgcaaatttttttattttttgaaagcggaaactatgtaaaggcaacccgaaggctgccccaggcatcaagcctatcctgtttacacaggttcattatcatcttcatcgacggagctatcttcatcgtcgtcctcaaactccggatcgtacccatagtcctcgtcatcgtccacataatcagcatctgggtcaggctttgccgcttcctgtgccttcttcttttcctggactttcttaaatacgaagaatccaccaccacaggcaagcacaatcagagtaagaatcgccgggagcatatttgtggatttcggcttttcctccggtgtcggttctgtaatttcaggaactgtttcaactacttccggctttgtttcctcaaccggcttggtgaactctgcaacttcttcctcgtccatcagcttgagcaggtcggcttcatccacctgattcagaaaatgcacggtttcctcgcccttatcatcacggtcaatgatgatatagaagtagtttccgtttttggttacagcggtaatgaactgctttccgcttttcgtaggcgagccagcgtcatcaaccaaagtcagattgccgtcgggagtaagcggtagcatcggctcctccggctctgtttcgggaactttttcttcgaccgcaggttcttcagtcgctacgctttcatctacataggcaaatgccgttgtagaaaacacgccaaaacacattgcacacgccagcaatgcggctccaattttcttaaatctcattctgcgtttcctcctcattcatagtattgatcgtatcaggcttcggagccatatccgcagcaaacatacggagcagctcggaaagctgttcgggattcaggttcgcagcatgaaccatctcatggatttcggaattttcctcctcacggtatctgcgttccaggtctttcaccttagcatcccattctgcccgtttcttacgggctttttcaaggtctgcacctattctgtctaacttggcactcaatcgccatccctcctttagtttctgattctgccgaagcagtaaaaatgctgttgccagtaattcgattcgatagaagcgtaggaaatggggtttccgcagtggatcatcataccattgccaacatagataccaacgtgtgatgcaccggaggtatcataagtgccttggaagaaaatcaaatctcccggtttggcagagcttttcgggataatgtcgcatacgcccatcaaaccgtttgcggtcaaacgaccaacactccaaccgtttccgcagtgattgattacataggaaacaaatccggagcagtcaaaggaggtagacgggctgctgccgccccacacatacgggtatcccagatatttttcagcttcccgaatcatattggcaaatcttgtgtctgtcagcgcttcgcccggaatatcataatcggtgtactcgccgccaggggtggcgtaaatgtcatttccgaaaatatccggtctgttgccccttgtctgaagcaaaattctatatcgctccatatcatcttccgacaagccggaatttgaaatcacactgttcaagcccttatttctgagcttcacattcagaatataatattcgtaatcttcttcctctgttgttgtctctcccgtttcgggatcagtagaagatgttgttcgtgtacgaatctctactacttccgtcagggtcagctcatattgttgctcaaatagccattgcagggtagcctgcacctcatctctggtgtaatcctcaaacttcaccgtcaaatacgccgccagctcataaggattgtggttgatttcatcaaggtcataccggtactcgtcatatccgctatgagtacgctcgatattattgattttattgcggagcgcagcttccaaagccttgtaatcattgtccgcaccaataatatcttcctcttttgcagtaaaagaagttcccagaatgatctgtgtgccgccttggaacatagccgaacaagacgagaacatccctgagagtatcataaaaagcagtccggcaatcaaaacaaacagaatcgttttagagtgtgtggtgcagaactccgttactctttctgtgatgttcttggctccctgagctgctttgcccgttgccttgcctgcacccttagatgcagaagccgttgtcgaagcggtattcttaccggctttggcggcagcatattctttcttgattgcccttttctgttgccaacgggaaaagggattggaaccggcatcggggttgtcctttttgaacttctcatacagggcatttacatttgctttatctgacttctcaaccagcttttccgccttgtcgtaggctttcagcttgtgactgtaaacggcatgatcgacggtatagacagtggattcaacagccttggtcgtttcctgcacagcctgaacgccgatattatcatcctcatattctgacaccgcccgatgtgctttggatgtgagcgtgactgcggcaccacggcttgccatgtgctttgccacagatgggcgctcgatttccgtaaactccgctttttcaaaacggagctttgctttacgggaaccggctgcatctgtttccagctttagcttcggctttgcctttttagaagccaatttgtctgccgctttttcagccctatcaaccgccttatctgcacggtcggcagctttcttcacatgagaatctgcaaggtcatcttcggtaaaacggagtcgtgtaggtcttttcgccatacattacgcctccttttcctgtgccacctcgtttaacttcgtggtcataatgcgatacagttccagatctgtcgggaatcggtcaatgaacggcagaatcacattgccatagaacagaagtccttcgccctcaccggagttggttacataggacagctgatgcggcgaaatgttcaaccgctgtgccagaatacttcggtcatcgcttgcctgattcagcatatagatgaaatcagagttttcgaggatgttggcaatctccggggaacgaagcaggtctttgacattctgagtaataccggtcggcaagccgccccatttacggaatcgcttccagatttctacggaataggttgccgtctgttcttccttcagaagcagatggaactcgtcaatataatatctggtcgatttaccggcagaacggttggcagttacacgcccccagacctgatcctgaacgatcagcataccgatttttttcagctgattgcccagctccttaatgtcgaagcacaccagacgattctgaatatccacattggttctgttgttaaacagtttcagagaacccttaacatagatttccaaggcggtcgctacatggtgggcttccttttcgtcctgtttcagaagggcatcatacaaatcctcaaggatcggcatattctcaggggcaggattgtcgaaatatctctggtaaatctgatgcacacaacggtcgataaccgtcttttcgataggctgcaagccatccttactgcccataatcaactcacagagggacaggataaaatcagctttcagtgctaccgggttgtcatcctcagagtagttcaggttgatgtccatagggttgatatagttggtactggaggagctgatttttaccacctgaccattgaacttgtgaaccagagccgcatattccgcttcggggtcgcagatgataatatcgtcatccgtaaccaggaacgcattggtgatttcacgctttgcggaaaaggatttaccggaaccgggagtacccagaatcagtccgttggggttcttgagcttctttctgtccaccatgataaggttgttcgacagagcattcagcccgtaatagagcgtttctccaccattctggaacagctcctgcgtggtgaaaggcacaaaaatagccgtggaactggtagtcaggccacgacgaatctcaatcaggttttgtgccaaaggcaggctgctcatcagtccggattcctgctgaaaatccaaacgacgcagattgcagttatgcttctgggcgatgctctgtgcctggaacacattgttctccagttcctgctcggtgcgcccggtgttcagcaccagaaatgtcaccatgaacattcgctcattctggctctgcaattctttcagaagtgacttcgcatctttaccataggtagcaaggtcagatgggataatgtccatgtcatagccagaacgcacagcctttttctgttcctcgattttggaacggtcaagctcggtgatgattctcttgatggtcttaatcgccgcagtctggtcaaccgactggatgtgcatggtcacgatctgcgtggattccatatccagaaaatccgccagcatacgatcagacaggtctgatgccgtaattgccagataagacatcgaaccgaagatactgcccatctggaaggtgcggttggtcttaaaggcaaacgccgtcggagcaatgaagtcctttacggacagcccggattccacaagatacttccaatcgaagaagaacttatcattatcacccatgtggaacatagagtgcatcagatgcagccgctctttgccgttcatggtagtggcaatgacacccaaacgccgaaagttattgagcagatcgttttcgatatggttgagtctcggctttgcctgccgcatggattcggcttcaatgccgaatgtcaggtacttggttttggtcaagccgttgttgccctgcgccaactgctttttcagcatctggctatactcggcacggacgggattgaagctgtccttcttgaacgggatacggatactcttttcaaagctttcagcatcggtactcaggttcataaaggaaagctcaaagtgaatggagctgtcaaagaaattcaggaaactgcaccactcatcgaagatggcagtcttatcttcctgctgtgccagctgatagttgatgtcctgaaactgaatggtcttggtgtaataactgtcagtgacacggcagatgccatccgggaacattctctgaaagggaatggactgctgtgcagtctgcggaataccgttgtccttctttgcccgttccacaacagctttaatttctcgctgctgcttccgattcagatttgcaggcattttgatgtttcttgcctgtggcttctttttgaaaaacaattcgttcaacctccttttccagtttgtactgacgcatcaaagcgtcataatagttgtccgtctgataagggcgaaccttgggacgaacgaatttggtctgaatgaagtgttctacaaccacttccaacggctgactatccttttcatacattgccagaaagaacaacggtaacatgacgatcatcatggacagtgctgcaaggctcacatttccggttgctttgaccagaaagaaaatcggcactccgatgagcgccgccgcaccaaagcaaagtaactgccgtttcgtcagattgaagaacacttttgtttttaccctcgtcaggtcacgaggtacgggaatatacgctgccaaacaatttcctccttcccttagtgagcgctgaatacacccttcgcaagcgaaccagtcttaaacagggtgaagcacaaaaggacggtgtagcccataacaccccagatagaaccgatgatgtcatcactgaatgcgatagactgaatcagcaccgcataaatgcccacgcagatcataatcaggaatccctggaatccgattgcaaacagcgaacgcagataattctgtccgatattgctctgttctctgtttccaaaagtggaaagcggaatcggggcaaggctgaccatcagataaatttcaatcattcgaccgtagacgatcacaaagatgatgattgccaaagcggacatcgtgacctgcacgataaaggattgcaggaacaagccgagcaaaggacccaaatccattgccatcagcgtttcttccattgtttccaatgccgaagcatctatggcagtatttccggatatgataccggcgcttgcgtttataacgtgctgtgtcacatcaaacacagccatcgtgatattgaatgtgtttgtgattaacatgaccgcaacaaaagtcttgaacacccatttgaagaagatccaggtttcaaaatttgccagattgttgtggtcaataatcatctgaattagctcataacaggcaatgaaggtcagaatcaagcctgcgattgggataatcactgactcggagatgtttcgtaccatggcaaagacacccggcgaaaaattcgccggggtcatgccaacggaggttgctatctcgccaacctggttgttgacggactcaaacatccccgacagatttcccataatagctgaaacgagcatttctttcagccagtctgtgatctgttggagtatgctgtccaaaggcgattacctccttgttttgtgattaaccgaacagtccggagagcagaggtacaagggtggtgccgatgagggcaacaccgccgccagccatgagctgcttcatgccctgggactttgcgccggggttatcgttgccgtagccctcaagcagattgattgcaccccagatgccaagacctgcgcccagagcgataacgagagtctgaagaacggttactgcgctattgaaaaatgccataatattttcctcctaaaatttgaaattgttttgagaatagaaaaagccctccgtactaccggcatcaaaaccggacggaaggcttagtttacgagaatcttttcaaggaactcctcgacggttatcacgccaagtttctgttccattctgcttcttgcatattcagtttcacaatcatatatatcaccaccacctttcataagaaacagccaatacattgactgcaacaaatcttcacgagaagcacagattgtcggtgaaaaaacgacaggtgaaaccttcagaacctctgcgagtttcgctgtggtttctgcattaggggttcgagcgtttttctcatactgagcaatacggacatccgctgttttctcggaataccccatcaggagtccaagctctttctgggtaaggcggcgaaatcgtctaacgaacttcaatcgctgcccaatagaggtatccgtgatccaccaagtcattttttttacacctcgctttctgcaaattctcgatatacaacctcattttttgctctgcgcttgcctacggcttcactgggagcaaggtcagggtaggttgcctgcactttctgtctgcttctgcggacagtttcaaaccccggaaagctgcgtctatccagttccttcaaaaacacaggaaccgtcatggcatgaatgtcgatgccacgcagaccggaatagtgttccagtaccatcaggtacaaatgattgtcggtatttcttgccttgtggtcgtgttccaagatgttcttaaccagggcagataccgttttcagattttccaaacagaaacctccttaatccgcatcgactaccacaaactcatcacctgccttgagcttcaaccttcgactcagaaactgctcaatgttgaactcatttctcttatcaaagtctgatgtgtacttataattggggtgctgcgtcagatcgtacttgtcagaaagaaacggtctgacaccacgcaactgcaaaatacacttgctgccatccagaaccgcaagctcatctacgctcgcaaggtctttgcctaacttctgataattcaagccgtaagacgggctgttacctctggtgttggaggtgttgtaggtgtcgatagtttcttttcccaatgcctgattcagttctttgagcgtggttggctcagaaccacccaggaaaattcgggaatccatgttgccgatgatggtatcggcattgtctttataaatggctttcagctgtgattgtgcctggagaacaaggcaagccgatatttcacggcttcggattgtcgctaccagtttttccagattgggaatctgaccgatgtttgccatctcatcaatcaagcagcgcacatgaaccggcagtctgccgccgtacacatcatctgctttctcgcacaacaagttgaacagctgtgtgtaaatcatggagatcaaaaaattaaacgtcgcatccgtatctgacataatcagaaagagcgccgttttcttatctccgagagtatccaactgcaactcgtcataggcagtcacatctctgacctcctgaatatcaaaaggagccagacgagcgccgcaggaaatcaaaatcgacttagcggtcttgccagagacgaaaagtcaaggactttttcatcaaattcaataagaagttacattttgcggacttcttcacggagcagacgcttgattttgtcctccatcgtttctttagcggtctcgctgaaatggacacggacgatataggtggtcttgccaatctgctttctgacagtcgggcaagggctgttgttggtggtgctgtgggttgcagtattgttcattcaaaatcctcctgtaaatgaaaaatgcccggtgactattcatcatcgggcggtgtcggtatgagggaagaaggcaaggcggcaacattaaggtatctataaaaaccttgccgcctttgccacgcttgccgtgttcctgttgtcagtctcggagatagcagacccatgctgtgccgtctttctcggtcacaagcctgtccccgatacggctctttgccgttctcatggtgcgtgaggaaatcccacgctcattgaccgtcttttccagctctgcgctcggcatacgctttccgtccgcaagcagttccagaataagcatttgcgcctgtgcggtcttgctctcggtcttagcggtgtccgtcccggcaagaagctcgtcagcggtaatgtcataagcccctatccactcaaagcctttctcatctcccagagaaaaggcaagggactgtccgggcggcgcaagggagcttttctcatggataagcacccttgttgtggggctgtctttcagcttgccgataaagagcagactgcggactgccgctgtaatgtcgatagaccctaatcctcggtaggtgctttgcgctcctgtggctttgttgaggtgtcctatcagcacgatagcgcacccagtagcctgtgcaatgtctcccagacagcggaatatcgggcgcacctcgttagccctgttcatgtcaacatctgccccaagaaacgcctgtaccgggtcaataataaccagccttgcattgttctcccggattgcccttgctatgcgttcatcggcaagggtcagcggtgtgcccctgtcgtcaatgacaagcactcgttcaaggtctgcgtccgcttcaatcagtcggggcttgacggtatcgcctaaaccgtcctctgcggtctggtagatgatattgaaagggtcaagggtctccatgccgggcaaaggctttcggttggtgcaagccgccgcaaggcgcatggcaaagtaggtcttgccctcaccggggttgccctgtatgatagtcagctttccgaatgggatatacggaaaccatagccaatcaacgctcgtcagctccacatctgccatacgaagcatggggacaggcttggcagttggcagctctcgcagcgtgattgtttccgctatgaatctgcggtttggaatgtccttttgctgacggagaacatcgttccagtctttccgtgccgggacaaggcgaatgacggcgatctcgctgggaatgtcctgcgccagtcgagtgcaggcttcacttcctgcggtgtcgctgtcaaggcagaggaacactttcaaggtgtccttgcgttcagaaagaaaacgatcaagggctttgcccgaaacgccgcccagggcaagatagctccttgtctgccagtcctgcggataaaggcagataaaggacaaaaggtcaatcggtgcttcaaagacaaagagctggttgccgttgccctcatagcggaatggataagatttatcggatccggtaatgtcctgtctgaaagtgtctgccgttcctcgcacatgagcgtatctcggtgtgccgcttcggtctctgccgacaaacacaacattgtgccgctttgcgtcctcgtaaatatccccagaaagaagaaaagcctcaacaagcgttttgttgagacctcggctttcgcaaagatattgaattgctctgtcggctgttcggttgtgcaagggcaagtgaaacgctgtggacggagctgtgctggcttcggtctgtccctcgccactttcaccggtcagtagctggacggcttcgggaaaggacttgccgtaaaactccatgacaaaatcaatgggatagccgcccttgctctggctgtggcgaaaccacttgtttccccggacggtcaagctgtcatgttctttccagcggtattctcgtccgcttttgattagtgtctctccctgtgtgcggagaaaatcttccagactgacggcgtttgccctgtcaatctgtgcttgggtgtaattcatcgggatagttcctcctttttgtgtcgtgtttggggtcgattttggagcttttcttgctctgtgtgctcgttaaatcgggcggcagtatcgacacatgacttgaccttccaaaggcggtgcaaatcgtctctgacggtcttaaactcgctgtaggtgatgtcatgtgcctgttccagatcgtcatactctgcggacagctttttcatatccaccttgccgtccgggaactccccggtcagctttcgtctggcggcgtagaactgtttcagttccgcttcatgctctgccttgtacttggctctgggcttctcaaacttgattttctgcaagccgtcatagaccggcttcaaactctggaatgtagcggagctgtcatagagctgcttaatcgctttcattcgtgcggtctgtccgtccagcgttttcttcaagctctctgtggttgcgctgtgttcgctgacacggctttccaaatcttcaagggtgtaaataccgtttgcccggagataattgaaagtctcgttcatctcctttaggttgctgattttgcctttctgggaatatgccccggctttgcgctgggtgtaataggcgttcagcagagaaacaaggtcgggggtctgcggcttggcaagctcggctttcatgtccgctatccagccgataagagaagtgattttcttcttgatgtcacggataacggcgttggtggctttgatccagcggttgaactcgcccttttcggtgcgtatgcctttcttctccattgcccggacggctgcgccctcatggatggtgggaagtaaatccacgccctgacgctcatagcttcggtggtcgatacggacagcaagccccttttccgcaaacttggcgttgcatagttccgcccatgtcttccgccagtattccagcgtttcgggactgccccagtcagtagtgggaacggcattgaacacaaaatttccatctgctccccggatacggttgccgtcctcgtccagctcatacactcggcgttgctttagcccccatttgccgtcctgttcgatgggacggataggacaaagcacatggaagtgtgggtttggtatgccgccgtcctcccggtctggctggtgtacggcgaagtcaactaccatgccccggctcacaaaattctccaataaaaattgccttgcaagagcgatgttttcctcaagggaaaattcattctgcaaggcaatgtcaaagctgtatgcaagctgggcgttctttccacgctcggctttttccacggcgttccatagcgtctggcggtctgcgtattcgggcggtgcatgggacggtagaagaatgtcggagcatatcacgccgccctttcgggtgtagtcgctgtactcgccgtaatactcgctatacaatctctcgccggaacggtaggcggcagaagcgatagcggactgtcctttactgcgtttggtctgggtgactgtgaagtggaatattgccatcggctttctgctcctttcctctgttggcttggctgatgtgggtaatcgccatgtgtcggacggctcgctggacttcggacagagaaaagatgtgctccatcagctctgtcatttcggtgcgtgtgagatctttgacctccggggcaaggctctcaatcgtgccgcccagattgcaaaggcggtgggtgcgcttttgtctctcgcctttctccagatacttctttcggttttccagacgcttcagcttgtgctgttcctgtgcaagctgcgtctcggctcgttccttttcggctcggagctggtcgagggttttcggttttgccattttgtttgacctccttttttgaaaatggggataaaaaaagaccgtcaacttttcgcacattgcgaccagcggacggtcagtttttcagtattcggtttttcaaacttgctggcggcgaacggtttgtcagaaccgtttgcggacggcaagtccacaggggatagccgcattagcggcgcaagggggtgtagccaccttgacggaacgaagtgacgcaacattctcagtcaagcagttttcttctgctgacggagaatgaagctccacaggacgcacgatactcccgttaggagagtatagaagtgcgccctttagttcctaaaggggttttattcaagcgaccaaccatttgtcaacataagcagcaattctgttgctccaatcaatttcatcagcagagttctcaatttcatcgatagctgtttgcaaaaatgtctgaacgtcctgcggttgaggtatgccgttgcttgcataggaattctcaatcaatctcataaacgaatcgagttccaacggaatgattttaggctttcctccgtatgcggcaatatttctaatttgatttagcccaaagaaatgtgcccatgttgcccggttaatggagggagcgataaacaggcaataggttgttttctttgttgccttttgcaactgcgcataatgcctggtaactggttctccttcagattcatattggcgctgtccacgctgcaaagtaacttccactgacagagcaaaagtgtcataatcacattcaatatctggcatattgccctccggctcctttaccaatgtggcggacgcgggcggcgtctataacggccagtgggtccaggccgtcagccgctgggtaacgactgtgtacggcaagccggagcccctgcccagaacgggctactaagctgcaatcctggagcgtcaaaacttccctcaatttgaggggagttttggcgctccccttttgaaggaggaacgtatgccagactatcaagccgttttaagcagccatgagatcagcaagaatatcgctgacctgctggaggacattgaccccatccagtacaacggcagcaaccgggcccgccgtgtacggaatgtaaacgactatatccagggccggaacgatatgccgctggaacccctgctggattgggcggcaaaagcggatagaggggcctatgccgggaaagtggcggtgctccgccagtctatccgggactttcaaacgcaaaaggccctgctgaccgtcccctataccaggaccagccataagcaattcgagtacaagaccatagaactggagatggaccggcccatgaaggtcattgaccaacagatctatgatcgggcagcgaaatcaggttttccgcgtaatttcttccaggaaagctattttgaccatgtgacactctattgtatgccggacaatgccaactgtaacttttctcatttctccgactgctcttttcatgtatgccgcctgtatggggtgaaattttgggatacgaggttatatggctgtgagttccactcctgccggatcgaatttactttattcccggattccacactggcaaacacgcatttccgggactgctccatccattccgcggcctttctccgcagtcgtatgacccgctgcaacacggttgactgttccgtggggcggctgaacttcaacggggcccgtctggatggctgtacctatggccggatcacacgattgcctaacagccggatcgagggcctggaggatgcttctattacgatgggaggggcgacccaggaggaagtccggtataaccgtaacgccattttccacgccctgggggagcaagacccggaacatcccccggccagccgggaccggccgcctggaccggagcggtgagggggcggctctatgcgtagaaacaacaccgtaagccctctcctgtgggcggcgctcaccctgcctgtcctctatctggcggccctcctggcctccggctatgaggagggtatgactgtctttgacctgatgggccatttcagcggactgctggagcggccctttgccatccgctggacgcctcacacccccaaattcatgctgggagccctgctgatctacggcttctccgtggtgctctactgctccaccagggagaacaggaggcccggtgaggaacacggctccgccaagtggggcagtcccaagctgctcgaccgcaagtaccgggacaaggcacccttccagaataccatcctcacacaaaatgtccgcatgggcctcaatggaaaggtacaccgccgcaacctcctgcaaatcgtcatcggcggctccggcgcgggcaagacaaggtttttctgcaagcccaatctcatgcaggcgaattgcagttttctggtcacggaccccaaaggggagacgatgcgggccgtggccccgctgctcatcgaaaagggctatgttatcaaggtgtttgacctcattgacaccgaccgctccgacgccttcaacccattcccatacctgaaggacgacaaggacgctatgaaactggtgaacaatctgattaagaacaccacaccgaaaaattccaccaacaacgacccgttttgggagaaatccgagatcgccctggacaccgctctcatcctgtatctgctccatgaagccccgccggaggaacaaaatctggagatggtcatgtatatgatcgagaacggcggggccagagaggatgacgatgattttcaatcccccctggatatgctctttgaggcgttagaggaggaagaaccggatcatgtggccgtgcgggagtataagattttcaagcaggccgccggaaaaacagccaagtcgatcctgatttcctgtggtgcgcgtcttgccgtgttcgacattgcagagctgcgtgaggtcacggcttatgatgagctggagctggacactctgggagataggaaaactgccctgttcctcatcatgagtgacactgatgacagttttaatttccttatatctatgtgttatacccagcttttcaacctactctgtgaaaaagccgacgatgtgtatggcggcaggctcccggtccatgtgcgctgtctcattgacgagtgcgccaacattggccagatacccaagttggaaaagctggtggccaccatccgaagccgtgagatctccgcctgtctggtgttgcaggcgcagagtcagctcaaggcgatttataaggataacgcagataccattatcggaaacatggatacttccatctttctgggcggtaaggagccgaccactctcaaggagctggccgccgtgctgggtaaggaaaccatcgacacctacaacaccggagagagccgtgggagggaaacatcccattcactcaactatcaaaaattggggaaagagctgatgagccaggatgagcttgctgttatggatggcggcaagtgtatcctccagctgcgcggtgtgcgtcctttcctttcggataagtacgacatcaccaagcaccccaatttcaagtacactgccgacgcggatgacaagaacgcttttgatattgaagcattcttgtccgcaaggctgaaactcaagcccaatgaggtctgcgatgtatatgaagtagacacaaagggcgcttaatttcgttccgctttagaagggagtgatcttatctattcgccgcatctgccctctatgggccattggcgtacaaagcggacaatcgcgagaaaaaataatgaaaaaggaggacagccggaatcatgcccccggaaaccgggcggcagattgttccggcttttgtatgcctatgaaacatgacaaacctattttttaatcagattccggctaacaaactatatggcattttttgaacaggcaatcaccgttcttcagaccctcgttatcgcgctcggtgccggtctcggtatctggggcgttatcaacctgctggaaggttacggcaacgacaaccccggcgccaagagccagggcatgaagcagctcatggccggtgctggtgtagccgtggtaggcatggtccttgtacctctgctctccgggcttttctctgtctaagcgtctccgtatgaaatccttgccgctcccgcagttttgcgggggcggcggaaaggaggttgacaccgtatggatttcttacttgaagccctgacaaattggctgaaagaaatgctggtgggcggcattatgagcaacctttcggggatgtttgacagtgtaaaccagcaggtcgcggatatatccgtacaggtaggccagaccccacagggatggaatggcagtattttcagcatgattgagaatctgtccaactccatcatggtgccgattgcaggcgtgatcctggctatcgtgatgaccgtagacctgatccagatgatcgcagacaagaacaacctgcatgatgtggacacctggatgattttcaagtgggtgttcaaatcagccgctgccatcctcattgtcacaaatacatggaatatcgtgatgggcgtctttgatatggcgcagagcgtagtggcgcaggcggcaggggttatcaattcggatgcgtccattgacatttcctcagttatgaccgatctggaaccgaggctgatggaaatggatctgggaccgctgttcggactgtggttccaatccctctttattggcattactatgtgggcgttatatatctgtatctttatcgttatttatggccgtatgatcgaaatctaccttgtgacttcggtggctcccgttccaatggctgcaatgatgggtaaagaatggggcggtatgggacagaattacctccgatccctgctggcgctgggctttcaggcgtttctcattatcgtctgcgtggcaatttatgctgtgctggtgcagaacatcgctctggaagatgacatcatcatggcaatctggagctgcgtgggctacaccgtactgctgtgctttacgctgttcaaaaccggcagtctcgcaaaatcagtctttcaggcgcactaaaggagggttctgtatgaaaaaatatcaaatcatttacgcagacccgccatggaactacaaagtatattccaagaaaggattgggacgcagtgcagaaagtcactatccgaccatgagtatcgaggatatttgtgcgctgccagtaggcaacttggcggataaagactgtgccttgtttttatgggtcacgattccatgtttactggaaggtctctcagttctgaaggcatggggatttacctataaaaccgtcggctttgtttgggtaaagcaaaatcgaaaggcagatagcttgttctggggaatgggatattggacgcgctccaatgtggaactttgtatcctcgcaacgaaaggacatcccaagcgtataaacgcagctgttcatcaggtcattgtctctcacattgaagaacattcaaaaaaaccgcaggaagccagagaacgcattgtctcattgatgggtgatctcccgcgcatagaactgtttgctcgtcaatccacacccggttgggatgtgtggggaaatgaagtggacagctctatttcattcccataaaggaggtggataatatggcttatgtacccgtacccaaagatttaaccaaagtcaaaaccaaggtcatgttcaatctgacacgaaggcagctggtctgctttaccgccggggcgcttgtaggtgtaccgctgttcttgtggctccgtgagcctgcgggaaacagcatggctgccatgtgtatgatgctggtcatgatgcccttcttcctgctggcaatgtatgaaaagcatggacagcccctggaaaagatcgtcggcaacatcctcaaagtagctgtgatccgtcccaagcagcgtccctaccagaccaataacttttatgccgtattaaagcggcaggaaatgctcgataaggaggtgtatgacattgttcaccgcaatgaaaagctggctgcgccgtctgctgggaaaaccggaagaaaagaccgtgcatccggtaaagacaaagaaaaagctgtcccgcgccgataagaagcagatcgaagcggccattgcccgcgccaaccgcacggacaaaaaaggaaaatcggcacaggacagtatcccctatgaacgaatgtggccggacgggatctgccgcgtatcggacagccactacacaaagaccattcagtttcaggacatcaactatcagctctcccaaaatgaagataagaccgcgatctttgagggctggtgtgatttcctcaattatttcgacagctcgattcacttccagctgtcttttttgaaccttgcggcatcggaggagacctttgccaactccatttccattccgccccagggggatgcctttgacagtatccgtgaggaatataccacgatgctgcaaaatcagctggtcagaggcaacaacggtctcatcaagaccaaatacctgacctttggtatcaacgctgacagcatcaaagccgccaagccccgtctggagcgtattgagaccgatatactcaataacttcaagcgtcttggtgtagccgccagaacattggacggtaaggaaaggctttcccagcttcatgcggtattccacatggatgaacagctcccgtttcagtttgaatgggactggctggctccttccggcctgtccacaaaggattttattgcaccaagctcctttgagttccgcaccggcaagcagttccgtatgggcaagaaatacggggctgtttcttttttgcagattttagccccagagctgaatgaccgtctgctggctgattttctggatatggaaagctcgctcattgtgagtatgcacattcagtcggtggatcaggtgaaagccatcaaaacggtaaagcgtaagattaccgatctggaccgcagtaagattgaggaacagaaaaaagcagtccgcgccggatacgacatggacatcattccttctgaccttgccacctacggcagcgaagcgaaaaagctgttgcaggatttgcagagccgaaacgagagaatgttcctggtctcctttttggtgctgaacacagcggacaccccccgtcagcttggcaacaacatctttcaggcaggctctattgcccagaagtataactgccagctgaccagactggacttccagcaggaagaagggctgatgagctgtctgcccctgggactcaatcagatcgagattcagcgagggctgaccaccagttctacggctatctttgtaccattcaccacacaggaattattccagaacggcaaggaagccctgtactacggcatcaatgccctgtccaacaacctcatcatggtggatagaaagctgctgaaaaaccccaacggcttgattttgggtacgccgggttccggtaagtctttcagcgccaagcgtgagattgccaactgctttttgcttaccaatgatgatgtcatcatctgtgacccggaagcggagtacgcacctctggtggatcgtctgcatgggcaggtcatcaagatctcgcctacctcaaccaactacatcaatccgatggatctgaacctggactattcggatgatgaaagcccactgtccctcaagtctgactttatcctcagcttgtgtgagctgatcgtgggcggtaaggacggattgcagccggtgcagaaaaccatcatcgaccgttgtgtgcgtctggtctatcagacctacctcaatgacccgcgcccggagaatatgcccatactggaggacctatataacctgctccgttcacaggaggaaaaggaagcccagtatatcgccacggcccttgaaatctatgtaaccggctccctcaatgtgttcaatcaccagagcaatgtggacatcaataaccgcattgtctgctatgacattaaggagctgggcaagcaactcaagaaaatcggtatgttggtggtccaggatcaggtgtggaaccgcgttaccattaaccgcgctgcccacaagtccacccgttattacatcgacgagatgcacctgcttttgaaggaggagcagaccgccgcttatatggtggaaatctggaagcgattccgcaaatggggcggtattccgacaggtatcacccagaatgtcaaagaccttttgagcagccgcgaggtggagaacatctttgaaaactccgacttcgtgtatatgctcaaccaggcaggcggagaccgtcagattctcgccaagcagctgggcatttccacgcaccagcttagctatgtgacccactccggtgagggcgagggcctgctgttctatggctccaccatcctgcccttcgttgaccacttcccgaagaatactgagctttaccgcattatgaccaccaaaccccaggaactgaaaaaggaggatgaataactatgaaacagaatatttgcgaacttgataccatgatttttttccgtgaggcattggaggctcacgaattcatgttgcttccggtaatggcctccgctgttgttgagtgtcgtaccgctgacaaagaactcaaaaccttgaatgaggatggcgaaattggtcttgcccgtctcttttcgatttgggcgaatatgatgtgtgcccctggtgcagcaaccattgtagggtgcagacctatcacaatgctctctgagattctggcgcaagtccatgcgtatctcaccgtgcatccgctatatgatccggaaggtttggccctctatgtggagctgcaccacatgatggatgctatcctaatgggtgattggtttgaataaagagccgcgcctgcgctttactgatgaggaacgggctgaccctgcactggaaaagccgatccgcaaaacggagaaagctacggccagagcagataaggcgcaggccaatattccaaagaaaaaagtcagacagacggtcattgacccggacaccgggaaaaagacctcgaagctgacctttgaggacaagaaaaaaccaccttccaaactttctcaaggggttaaggaagctcccgtccatctggtcgcgggcaagtttcacaaagagatccgggaaacagaacaggacaatgtgggcgtggaaagcgcccacaagtccgaggaggcggtggagaccagcgcttatctggtgcgggagggctatcgcagccacaagctgaagccgtaccgcaaagcagcccaggccgagcagaagctggaaaaggcaaatgtaaatgccctgtaccagaagtccctacgggaaaatcctcagtttaccagcaaccctctctcccgctggcagcaaaaacagagtatcaaaaagcagtatgccgtcgccaagcgcaccggtcagactgccggaaataccgcccaggctgcgtccaaaaccggaaaagccgcaaggacggtaaaagaaaaggcacagcaggcaggggcattcgtcatgcgccacaagaagggcttcctgatggcaggggtttttttcctcatcgcctgtatgctgatgaataccatgtcctcctgctctatgatggcacagagtattggttctgtaatttccggcactacctatccatcggatgacccggaaatgctggcggtggaggcagattatgcagacagagaagctcggttgcaggagaaaatcgacaacatcgaaagcagccacccagggtatgacgagtatcgctataaccttggcatgatcggccatgacccccatgagcttgcggcgtttctctctgctgtcttgcagggctatacacgccacagcgcacaggcagagctggagcgtgtgtttgatgcacagtatcagctcacgctgagagaagaaattcagattcgcacttacactgacgaagatggggatgagcatgaatatgaatatcgtattctccatgtaactttaacaagccgttccattgcctctcttgcgccagaactactgactccggagcagatggagatgtaccaggtctaccgacagactatgggcaataagccgctgttgtttggtggcggttctcccgatacaggtgtttctgaagatttgactggtgttgaatttatcaatggcacccgccccggcaatccgcagctggtggaactggcgaaaagtcaggtgggcaatgtgggaggacaaccttattggagctggtacggctttgactcccgtgtggaatggtgtgcctgctttgtatcatggtgctatggtcaatccggtcgaacggaaccacgctttgctggttgtcagtctcagggtgttccgtggttccagtctcatggacagtggggcgcacgaggatatgaaaacatcgcccccggtgatgccattttcttcgattgggatctggatggttccgcagaccatgtgggaattgttgtcggcaccgatggcagccgtgtttataccgtggagggaaattccggcgatgcctgcaagatcaaaagttatgacctgaattatcagagtatcaagggctacggcctgatgaactggtaacagagattttttagaaggagtgatagacgatggcaaagaacaaaattgaacgcattgaccaggagattactaaggtccgcgagaagatcgcagagtatcaggaaaagctcaaggcgctggagacacagaaaaccgaggcagaaaatctggagatcgtccagatggtgcgcgcactgcgtatgaccccggctcagctgagcgccatgctgtccggaggcacagttcccggcagtttggctgatgacaacaacgaacaggaggaaaacagctatgaggaataaacgattgctccgaacactttccgccatttgcctgacgctggttctggcattgggctttaccgttcccgcttttgcccagggcgcagctccgcccccggcagaggataccaccaatgacagcaatgtggtggtggaagaaacggaaaaagcacctccgctgaccccggatggcaacgccgctctggtggatgattttggtggcaacaagcagctcattaccgttaccaccaaggcaggcaactatttttatatcctgatcgacagggccaacgaggataaaaagactgctgttcactttctgaaccaggtggatgaagcggacctgatggcactgatggaagatggaaatgccaaagaggagccgccagctgtgtgcagctgcacgaagaaatgtgaagcaggggcagttaatacggcctgcccggtctgtgtaactgataagagtaaatgtacgggaaaagcaccggaacctccggcagaaacaccggagccggaaaaagagaagcctgccggactgaacccggctgccctgatccttctgctggctctgctgggcggcggtggcgtatttgcctacttgaagctcgttaaaaataagcctaagaccaagggcaatgacagtctggacgattatgattatggcgaggaagattccgaggaatgggaaactgaggatgaggaagtccttgaggatggttttgagggttctgaccctaatgaggaaagtgatagaacagattgaaccgtttgagcgtagcatatttcaaatcattgcgggataagggacagaggacagggagaaattcctgtcctctgctgctctactcactctcttactgcaaatctacacccaaaatcagcacatggtcaaagaaaggaggacctcacaatgaacacctggaacttgttattacactttctgattatttttgatctggtcgccttcggaatttactttggaggagacattcttttcactgctataagcaaagttcaaaaaaaatcaaagaaggacgatgacttggatctttatgattttgaaattgagaccgcaccccaaaaacgctctttatgtgtggactcaatccgaatgctttattctggtgagatagatgaatttgtggaaaaggaactgttgcctgatgcagcggagaccatgaacgctttatctgaagctgaaaaaacagcagttagcctgttactaaaagcttatatcggttttttgagcgaagaagcaacggtagatgaacaaagttttcccatggttaaggaactgttgtcttatacacagggcagcaaagaagatggtgaaaaagatgccatagattgtctgatggaagatacggtcagcagaacccacagacatcgagaatattacaacaattatcaacgctatcaactgatgcaggtggataaagagcgtgtgattatggcctgcaatatcataatcaatgatttgattggcaggttgtaccgatatgattatcgctttggctatgacattacacttgcctcagaacacagcattgcaaaaaaactgtctgataattggcagaatgaatgggaggttgaagattatgaagctggtgattgctgaaaaaccatcggttgcacaaagtctgtcggcggtgattggtgcaaccgcccgtaaggacgggtatctggagggaaacggctggcgtgtcagctggtgcgtgggccatctggccgggcttgcagatgcagacagctatgaccccaagtatgccaagtggcgatatgatgacctgcctattctgccggagcattggcagatggtggtgggaaaggataagaaaaagcagtttgatattctcaaaaagctgatgaatgccccggatgtgacggaggtggtaaacgcttgcgatgccggacgcgagggcgagctgatcttccgcagtgtctatgagctggcaggctgccaaaagccgatgaaaaggctttggatttcttcgatggaggactccgccatcagggagggctttgcaaacctccgccccggtgcggactatgacggacttcgggatgctgctctctgtcgtgccaaggccgactggctggtggggatcaatgccacaaggcttttttccgtgctgtaccaccgcaccctcaacatcgggcgcgtgatgtcccctacgctggcactcattgtccagcgagaagctgagatcgacacctttaagccggttcccttttataccgtggcactggagctacccggtcttaccgtatccggggagcgcatggcggataaggccgctgccgagcagctgaaagaagtctgccagggtgcagccgtcacgatcaaaaaggtggagtgcaaggaaaagtccgaaaagccgcccgccctctatgacctgactactctgcaaagagatgccaaccgcttgcttggatttacagcccagcagaccctggactatctgcaaagcctgtatgaaaagaagctctgcacctatccccgtactgacagccgctatctgaccggtgatatggcagacagcctgccggtgctggtcaatctggttgccaatgctatgccgtttcgcaaagggatcgccattacctgtgatccgcagccagtcatcaacgataagaaagtaaccgaccaccacgcagtaatccctaccagaaatctcaaggatgcagacctttctgcccttcctgcgggagaaaaagcggtgctggagctggtggccctgcgtctgctgtgtgccgtagcccagccccatatctattcggaaaccgttgtgattgccgactgtgccggtggggagtttaccgccaaaggaaaaacagtgaagcaccccggatggaaagcactggaggacgcttaccgtgccaaaatgaaggatgcggagccaaaaaaagagggcgcagagaaagccctgccggagctgaccgaaggacagaccctttcggtttctgcggcaatcgtcaaagaaggcaaaagcagtccgccccagcactttacggaggacaccctattgtccgcgatggagactgccggaaaagaagatatgccggaggatgccgaacgaaaaggtctggggacaccggccacccgtgccggtattttggaaaagctggtatctgccggttttctggaacgaaaaaagagcaggaaaacggtgcagcttctcccttcccacgatgcagtttcccttatcaccgttctgccggaacagctgcaatcgccgcttttgactgccgagtgggagtaccgcctgggcgagatcgagcgcgggcagcttgccccggaggagtttttggacgggatcagcaccatgttgggagacctggtggggacttatcaggtcatcaagggaaccgagtacctgttctccccgccccgtgaggtggtaggcaaatgcccccgctgcggcggtgaagttgcagaactgcaaaaaggcttcttctgtcagaatgattcttgcaaatttgcaatctggaaaaataacaaatggtgggctgccaagaaaaaacagccgaccaaggctgtggtgtctgcactgctgaaagatggccgtgtccgtgtaacgggcctatattcggagaaaaccggcaagacctacgatgccactgtggttttggaggacgatggacagtacgccaacttcaagctggaatttgaccagcggaaaggaggcagccgatgaagctctctttagcggaacgggaaaccattctcctctataaccaggcagaaccaatggctgaggtctacacccacgatccccgtttgatggagaagctggaactgctggcaaaaaagcaccccgaccagatcacccgaaaggacgcccataactttaccgtccccaagcggtgtgtatcagtcagggagccatacagcgccgagcgtcgcaaagctgccagtgagcgtgcgaaagctgccggataccagccccctgtgagaaagtccagcagttaaaggcacatggcagagaatgtatttgaagcagtcaagcagtcggtcagcaccagagaagcggcagcgttttatgggatcgaggtcaaacgaaatggtatggcctgctgtccctttcacgatgataagaaccccagcatgaaggtagatcagcggttccactgctttggctgcggtgcagatggggatgtgatcgactttaccgcaaagctctttgacctctccccaaaagaagcggcggagaaactggcacaggactttggcctgatctatgacagtcaggcccctccccgcaggaggtatgtccggcagaaaaccgaggcacaaaagtttcgggaggaccggcagcagtgttatcgcgtactgtccgattactactatctgctgaaaaaatgggaggccgaccattctccccggacaccggaggagaaaccgcacccccgctttgtggaagcaatccataagaaaatctatgtggagtacctgctggatctttttctttatgaaagtgaagaagaacaaaaggcatggattgcagaacacacagcagaaatcacacacttggaaaggagattgaaaatcatggctgagaacaaacccaccaaccgagagcggctaagggaaatcacagacggcatcgagcagggcatcaaggaactgtttgagagtgaaaagtatatgcgctatctgtccgttatgtcccgcttccaccgctattcggtaaacaacaccatgctcatctatatgcagaagccggacgccactttggtagccggatacaataagtggaaagaccagtttgagcgtcatgttaaaaagggagaacatggcattaccatcatcgcccccacaccgtacaagaagaaaatcgaggagcagaaactggacccggataccaaggctccgattttggataaagacggaaagatcatcacagaggaaaaagaaatcgagatccccatgtttcgcccggtcaaggtctttgatgtgagccagaccgatgggaaacctttgccggagcttgcctcctccctttccggcaatgtgcccaattatgaggcattcatggaggccctgcgccgcagtgcgccgatgccgatcacttttgaagcaatggccgccgatacggacggctatttttctgccgatcatcagaaaattgccattcgtcagggcatgagcgaggtgcagacggtttcggccacggttcacgagattgcccacagcaagctccacaatcagaaaaagattcagattgccaatgacgagcaatatcaggagatcgagctgtttgataaacccggtctgttctccaatgggcggattgtccgtgataatctgccggagggcgtttattgctatgacctgcgcggttctgactacgaccccggagagccggtctgtgtagaagaacgagtggttgtaaaccatgcaggttccgttctgctgacagatccgctggagctggcggaaaatggacgcctgatgctgaccgaggaagaaggactgaattttgttggcggcttttctactctcgcccagtttttgcaggaacagaagaaagaccgtcacacggaagaagtagaggctgaaagcatctcctatgcagtctgcaaatattttggcattgaaaccggagaaaacagcttcggctatattgccagctggagtcagggcaaggaactgaaagagctgagagccagtttggagaccatcaataagacctccggcactttgatctctgacattgagcgccactataaggaaatctgcaaagagcgtggaattgaccccaatgcaaaaaaagagccggaaatggcggttcttgatgcggaggcaaaccagcaggaggctttgtttctaattgacgatgccacctatcttcatattcagccctgtgacagcggctgggactacaccctttacgatgccgcgtccatgaaagagctggatggcggtcagctggatatgccggagctttcccgcatgaaggcagttctccagatttgtgatgacaacgatctggacagcacttcacttagacacgctcccctgtctatgatcgagaccttgcaggaagctgcctatcagcagatgcaggcagaggtcggtcagatggccgcttcttcccagctgccggaggcacaggagcaggcgctggatgaatacccaacgcccgatgagcaggtctccacaccggatatgcagaaatacggttactcttatgacgggatgctccctgttacaagagaacgggcgctggaactggatgctgccggtttgaccgtctatgtgctgcatgaggacaatacggagagcatggtgtttgacccgcaggaaatcatggagcatggcggtcttttcggtgtggaccgcgaggaatgggagaaaagccctcagttccacgaaaaggtcatggagcgtcaggaacatcagcaggaacgagaacaggcatttctctcccagaacagaaactgctttgccatctaccaggtgagccgtaacgatccgcaaaatgtgcgctttatgaatctggactggttagagtcccatgatgtttccgtagaccgcagcaattatgacctcatttacaccgctccgctgagtgagtctggcactgtgccggagcagctggaaaaactctatcagcaattcaatctggaaaaacccgtagactttcacagtccctccatgagcgtcagcgacatcgttgcgatcaaacaggacggtaaggtatcctgtcattactgcgacagcgttggttttacccagatccccggattcctgccggaaaatccgctgaaaaatgcggaaatggccctggaggacgattatggcatgatcgacggtatcatcaacaatggcgcaaaagagcctacggtggcagagctggaacagcaggcccgaagcggtcagcccatttccctgatggagttggcagccgccacccatcgggaggaacgggaaaagaaaaagtccgtcatggagcagctgaaaggccagcccaagacagaacacaaaaagacagcaccaaaaaagagtgcggaaagggagatttgatatgggaaactttacttttgaggaaatgaacctgatgtgcatttacaataccggcagccgcaccggattgatcgacagcctgcgtgagatgcgcggcgagctttcgccggaggaaacggaactgagggagctaaccgacagcgcccttacgaagctctgtgcgatgaccgatgaggactttgcccagctggagctgtacccggattttgaccagtaaacagcataaccgcagggatggggtggcaatttgccaccccacctctttaccccaaaactgaaaggaggacagaacaccatgctaaccaaagctgaactatatgcacagatggcggacaaggtggcaacacagctcacggggagctggcaggaatgggcagggtttctcaccactgcttcccgtctttacaagtacccgttccatgagcagctgatgatctacgcccagcgaccggacgccaccgcctgtgcagagtacgatttgtggaatgaaaagatgggccggtatgtaagacgcggctccaaggggatcgctctggtggacgattccggagacagaccacgcctgcgctatgtctttgatatttccgacaccggaacccgtgaacattcccgcactccctggctgtggcagctggaggagcgccatctggattccgtgcaggccatgctggagcgcacctatgatgtttccggtgatgaccttgccggacagctcacggaggtagccggaaaactggccgaggaatactggacggagcatcagcaggacttcttctatatcgttgacggttcctttttggaggaatatgatgagtataacatcggagtgcagttcaaggcagccgccaccgtcagcatcacttacgctttgatgtcccgctgtggactggagccggaacgctacttcgaccacgaagatttcatggcgatctttgatttcaacaccccgtccaccatcggggcgctgggaacagcggtcagtcagatcaaccagcaggtgctgcggcagatcggcgtcaccgtccgaaatgcagagcgcgaagccaaccaagaaaggagcaaacaagatgaacaatcccatgacctacatccagaacggagactatctgattcccgacctgaagctgagccagcagccggagaaacctctgggcaaatacggcaggatgaggaaaacctacctgaaggaacaccgtcccatcctctacaaccagatgctgctgagcgagaagctgtaccagcaccttctggagatcgacgagaccgcccagaacagactggagcagatgatgccccagctggcgaaggaagcgggagccaccgaggaactgaaagccagcgatcccatgaagtgggtggggctgatgaacacctgcaaagctcaggcagaggagattctgatggcggagcttatcaacagctgaccctaaacctgttcctctccgaagcggaacagatccaatccatagatgaagcagagtatgtagcgcatacatcctctgctttttcttttgcccaaaatgatattgaccatgtgctgcgtttgggcggcaatacagaccgccagagggagcgtgtggttgcagcctttgaaaagcagaaaaccaccgctgagattgccgagatactgaaaacgctgtaccacggcggcaacggtcttggcagtgtgagcgcatggtatgccgaggatggtatccatctttcccacgggaagtctgtccgttatgacaggtctgcccaggtcatttcctgggagagcgccgcagagcgtatcggggagcttttggaaagtggtcagtttgcctccaatgtggagcttgcagaagcggcaggctatgaacgctccctccttgcagaaaagctctggtatctgtatcacgatctcagtgaggacgccagaaaagccggatatttgtcctgcctgtcagagatcaaaggcaatgggttcccggaggagacccaccgcctgacggagcagttgaatgacccggctttccgccagacactcaaggaagaatacgccgccttctggactgcctatcagcaggaccgtgacctgttgcgctttcattaccataggccaagggaaatctgggagaacctgaaagaccttgacctgccccgcaggactttttcttcggacctttcccaagtgccaaccgtccagcatttcattacagaggatgagatcgacaccgccatgaccggcggcagcagttttgccggaggaaaaggccgtatctatgcgttcttcatggaaaaccatacggataaggaaaaagtgagattccttaaagacgagtatggcattggcggacgctctcatgccctgtccggcgcaacacacagcggcgaagatcacgatgggaaaggactgcactataaaaagcaggactgcccggatgttcacttgaactgggaaaaggtttccaagcgcattacctcacttgtccagaaaggccgctatcttaccgaacaggaacaggcgcagtatgacaaaattcaggctgaaaaggaattggcagaagaagatgccattcaagcccagcagccggaggtggaggaagaaacgccaaagcctacccttcgggagcagtttgagcagtataagcctgtggtgactgccgccatatctgaggatgtggcatatcgaaatgcctgcggtcattccgaccgtgaaaatgctgtcatcgagggcaatgccgctgtgcgccgtgcggttcttggctctaaggatatggagctgatccgcctttattcggatgtgccggagttccgccagcgtttgcaccgggaagtgatcgacgaaacctatccaaagctccatgagcttctgcgccctctttctcaggaagatattgatactgccctttgtgcatggaacggcaatatcgagagtaaacacgctgttgtccgctatatgaaagaccatgcaagagaaaaagataccgccgcatggctggctcaggaatacggcggcagtaacagcaacagcctgttcgttgtccgtgccggcagcccggaggaaacgcagctgccatggccgaaggtacagcgcaggcttgcccagctcattcaggaggatcggttctataccgaagaagaacaggaccgttttgacaacatcgaccccatcgccatccgggaagctctggaggaaagagggattgtcaacggccaggtggcagacccggaaaaactggacaatgacccgtttatccaacaggtgatgtcggatgccgagcagatcgcagctgccgagacagaacagacttccgaggtttccatttccgatgaggaatatgatgcagttcgccgcccgactccgcaaaggacttcctatgaccctgccgccccggtctatgctgtgggcgataccgtgtatatcgagaatgacgcctatcagatcaccgagctgcgggaggacaccgtacagcttctgcccaccgggatggtatatcccatctaccgggcagagcgcaaagaacagttcgagcagctgcttcgggcagaccgccgcaatgcttactataccgagtttcttcctattgacccggacaaggcagaacaagacttgcgggatgtattggctcatggactgatggatgaagcggataaaaagcagatttccacgctgctgcaatccggcaggagcaacagcgagatcgcctactggctgagcagagcctattccggtgagattgagacactgaatctggagaccggcgatattgtcgattaccgtaccacggcacagggcatagaactggaagtcatggatgcagaggaaaagcgtctggctatgctgtatttccgctgggatgaggttgcgcctttgctgcgcgggatgtatgcccgtcagcaggacggttttggacaggaacagccccaaccggctaccgaatccccgaccttccattccgagaccatggccgtctatccgggcgataagaacaatctgccttatgatgtggtggtggaacgactgcatatcgaggagccggagccgccagcccctgtaacagagccggagaaaacctttgaggaagtgctggatgaacacccggtttccattcaggtcaacggccagtggcagaccttccccaatgccaaagctgccgaggaagcctcctatgaggaatacaaggacaacctgcgccgcaatgcacagaacttccgcattaccgatgagcatttgggtgaaggcggtccgaaagccaagttccaggcaaatatcaatgccattcgtttgctgaaagagctggaagctgccggacagcaggcaagcccggaacagcaggaagtcctatcccgctatgtgggctggggcggtctttctgatgcctttgacccggagaaaccggcatgggcttccgagtatgcccagctgaaagagctgctgaccccggaggaatatgtcgccgccagaagctccaccctcaacgcccattacaccagccctacggtcattcaggccatctatgaagcggtgggccgtatgggatttgagaccggaaatattttggagccatctatgggtgtgggcaatttcttcggtatgctgccggaggaaatgagaaacagccgtctgtacggcgtggagctggacccggtttccgggcgcatcgcaaagcagctctatcccaaggcggacatcacagtaggcggctttgagaccaccgataggcgggatttctttgaccttgccatcggcaatgtacctttcggtcagtatcaggtcaatgacaaagcctacaacaagctgaatttcagtattcacaactactttttcgccaaagcactggaccaggtgcgtcccggcggagtggtagcttttgtaacctcccgctatactatggacgccaaggattccaccgtgcgccgctatcttgcccagcgtgctgagctgctgggagcgatccgtctgccgaatgacgcgttcaaaaagaatgccggtgccgaggtggtatcggacatcatcttcctccaaaagcgggaccgcctgctggacattgcaccagagtggacccagaccggacagacgcaggacggctttgccatcaaccggtattttatcgaccacccggaaatggtgctgggccgacaggaaccggaaagcaccgcccatggcatggactacaccgtgaatcccattgaggggctggagcttgccgatcagctgcatgatgctgtgaagtacattcatggcacttatcaggaggcagaactgccggagctgggcgagggcgaaaccattgacacctccattcctgctgacccaaatgtgaagaactattcctatgccattgtagacggacaggtgtactaccgggaaaacagccgcatggtgcgccctgatctcaacgccaccgccgaagcccgcgtgaaaggtcttgtgggactgcgtgattgtgtgcaggaactgatcgaccttcagatggatgcagcggttccagacagcaccattcgggagaagcaggcggaactgaaccggctctatgacagcttttctgccaaatacggtctcatcaacgaccgtgcaaaccggctggcctatgcagacgattcttcctattacctgctctgtgcgctggaagtcatcgacgaggacggaaagctggaacgcaaggcagatatgttcaccaagcggaccatcaagccccatcaggcggtggctgtggtggatacggcaagcgaagcactggcggtgtccatctcggaaaaagcctgcgtggatatggactatatgagccagcttaccggaaaaacaaaagaagaactggccggagagcagcaaggcgtgatcttccgtgtaccgggacagctggagaaagacggcacaccccattatgtgactgctgatgaatacctctccggcaatgtacgccgcaaactgcgtcaggcgcaacgggcggcacagcaggacccttcttttgtagtcaatgtggaagctcttagcgccgcccagcccaaagacctggatgcgtcggagatcgaggtgcgtctgggcgctacctggattgacaaggaatatatccagcagtttatgtatgagacctttaataccccgttttatctccagcgcagtattggggtcaactattcgtcctttaccgctgaatggcagatcaaggggaaatcttccgtatcctacaacgatgtagcagcttacaccacctatggaaccagccgtgccaatgcctacaagattttggaggacagcctgaacctgcgggatgtccgtatctatgacaccatagaggacgcagacggaaaagagcgccgcgtgctgaacgccaaggagaccaccctggctgcacaaaaacagcaggctatccgggaagcctttaaggactggatctggagagatccggagcgccgccagactctggtgcgccagtacaacgaagaaatgaactctacccgtccccgcgagtatgatggcagccatatcacttttggcggcatgaacccggccattaccctgcgggaacaccagaaaagcgctatcgcccatgtgctgtatggaggaaataccctgttggcacatgaagtaggcgcaggcaaaacttttgagatggtagctgctgcgatggaagccaaacgcctgggcttgtgccagaaatctctctttgtggttcccaaccacctgaccgagcagtgggcgtcggagtttctgcgcctctatccttctgccaacatcttagtcaccaccaaaaaggactttgagacccataaccgcaaaaagttctgcgcccgtattgcgaccggtgactacgacgccatcatcatgggacacagccagtttgagcgtatccccatcagccgggagcgtcaggaacggcttctctatgagcagatcgacgagatcaccgagggcatcgcagaggtgcaggccagcggcggcgagcgttttaccgtcaagcagctggagcgtaccagaaagtctctggaagccagactggaaaagctgcaagccgaggggcgaaaagacgatgtggtaaccttcgagcagctgggtgtggaccgtttgtttgtggacgaggcccacaactataaaaacctgtttctatacacaaaaatgcggaatgtggctggtctttccacatcggacgcgcagaaatcctccgatatgtttgccaagtgccgctatatggacgagatcaccggaaatcgtggtgtgatctttgccaccggcaccccggtcagcaactccatgaccgagctttacaccatgcagcgttatcttcagtatgaacgcctgcaagagctgaacatgacccacttcgactgttgggcttcccgatttggggagaccgtcacagcattggagctggcaccggaaggcaccggctaccgggcaagaacgagattcagcaagttctttaacctgccggagctgatgaacctgttcaaagaagtggctgacattaagactgccgaccagctgaatctgcctaccccggaagtggaataccacaacatcgtggcgcagcctaccgaacatcagcaggaaatggtcaaggccctttcggagcgcgcatcgctggtacacagcggaaccgttgacccgtcccaggacaatatgctcaagattacctcggatggccgtaaactggggctggaccagaggatcgtcaaccagatgctgccggacgaacccggaacaaaggtcaatcaatgcgtagagaacatcatgcagatctggcgggatggcgaggctgataaattaacccagctggtgttctgtgatatttctaccccgcaggcaaaagctcctgcaagcaaggcggcgaaaacgctggataatccactgcttcacgcactggaaggcgctgtacctctgccggagcaggaaccggcctttacggtgtatgacgatattcatcagaagctcattgcccaggggatgcctgccgaccagatcgcttttatccatgaagccaataccgaggtgcggaaaaaggagctgttctccaaagtccgtaccggtcaggtgcgtgtgcttatgggcagcaccgccaagatgggcgcaggcaccaatgtgcaggaccgtctggtggcacttcatgacctggactgtccgtggagaccgggagaccttgcccagcgcaagggccgtatcgagcgccagggcaaccagaatccccttgtccatgtgtatcgctatgtgaccgagggaactttcgacgcatacctctggcagacagtggagaataagcagaaattcatcagccagatcatgacttctaaatcgccggtgcgctcctgcgatgatgtggatgaaacggcgctttcctttgccgagatcaaggctctgtgcgccggagacccccgtatcaaagagcgtatggatctggatgtggaggtatcccgcctgaagctgatgaaagccgaccaccagagtaagcagtaccgcttggaggatcagttgctcaaatatttcccggaggagattgaaaagcacaagggctttatcaaaggctttgaatctgacctggaggttttggcagctcacccgcacccggaggacggctttgccggtatggagattcgtggagatctgctgaccgataaggagaacgccggtgctgcccttttggatgcctgcaaggaggtcaaaacctccgatccggtgcagatcggcagctaccggggctatgccatgtctgtggaattttccgcttggaaacaggaatatacgctcctgctaaaaggacagatgacccacagggcaacccttggtacagaccctcgcggaaatcttacccgtatcgacaatgccctcgcccagatgccgcagcgtctggaggcggcaaaggcccagatggataacctctatcagcagcaggctgcggcaaaggaggaagttggaaagccattcctttatgaagaagaactaaaaagcaaaaacgcccgtctggtggagctggataccctgctcaacatcgacggaaagggaccggcacacgatgaagctgtcgttgccaaaagcacacggccttcggtattggaccatctgaaacgcccggtgccgccccgcagtacagacaagaagccaaaacagcatgaggaggtgcgataacatgaataccaacgatctaaatacagccctttatgaaaagatggctgccgagcaggacaaatacagggactggctgaaaagccagcccccggaagaaatcctgcaccacacctatgagtacacggttcgtgaggacattgtgatggcgatggaggaactggagctgactgatgcccaggctcaggcacttttggaatctccctctccgctggcggatgtgtaccgttattttgaaaagctggagaccggccatatggatgtgatccgggacagtattgagaaccgtgccgacgatgtgtgcagagctaaagaggaactgcgaacaacaccggtctatccccactctgccgcctatgcgagagaacatagggaactggagcagtaccgggtttccaacaatgcaaatctccaatgcaaggagtccattgaagcggcggtgcgggaacacttcgacggaatgtatctcagtcacgatgcggcaaagggtgtgatcgagacctatggcatggagcgtgtggcgctggtccttgccaacaccgtccagcttcaggactgggatgggcgttactcccgacgcaataaggaatgggccaagaccattcccaacgataatcccgaaaccgtccgttgtggttatgtcctgaacagccaccctgctgtgctggatggctttattgatctggtgcgagaagaacagcagcgcagccgtactcagggagaaaagatacaaccgtcccgcccctctgtacgggataagctcaagcaggaactgcctgcccataagcctgccgccccgaagaaacagggaccggagagataaccatggcaaagcgtaagcgggatatgcaattaaactttagagtttcagcggaggaacttgctgtgattgagcaaaaaatgtctcagtttggaacctccaaccgtgaagcctatctaagaaaaatggcgctggatgggtatgtagtcaagctggagctgccggagctgaaggagcttgtttccctgatgcgccgaaacagcaacaacttaaaccagctgacccgtaaagtgcatgagactgggcgggtttatgatgctgacttggaggatatatcccagcggcaggaacagttatgggagggcgtagaggaaatcattacccagctttccaaacttttataacagggatagatactccatttgcggagggaggaacggcattacttcgctgctcctctctccgctttttctttttatcggtatccttgtcttttgcctgcccatgccggataatatgattagaaaagataccaagaacgctgcaaggaggaaataacatgaagattttgaaagggcttttgatgattataactgcaccggtcattttggtgctgacgctttttgtctggctctgcacggggctgatctacatatccggtctggtgcttggtctgctcagcactgtaattgctctgcttggcgtggctgtgcttattacctattccccgcaaaatggtgtgattttgctggttatggcatttttgattagccctatggggctgccgttggctgcaatctggctgatgggtaaggtgcagagtttgaaatttgccattcaggattgggtttatggataaaaaatacgcaaagccacaaaatgccaaacaccgtctgttaaatttggaaagagaaactatatatccacgactttacttttgaactaatattgaatataatattagtacgaaaggaagtgacatgatgggacaatttgaacagctggatcagatgctaacagcacaagaaggaatgctgcgaacatcacaggtcgtatcctctggaatttcaaagccggtattttatgattatgtgcgttcacgagatttggatagagttgcacatgggatttatctgtccaaagattcctgggtggatgccatgtatctgcttcatttgcgatttgaacaagcagtattttcacatgaaacagctttattttttcacgatctgacagaccgtgaaccaatagaatatacagttacggtcaaaactggatgcaatccaagcaaaatgaaagcagaaggcattcaagtttttacgattaaagcagacttacatgatgtaggacttacaacagcgaaaactccgttcgggcatactgtgccggtttatgatatggagcgaacgatctgtgatttgctcagaagccgtagcagaattgaaattcagacctttcagggagcactgaaagcgtatgcccgtagaaaagataagaacctgcgagctttaatgcaatatgccgggatgttcaaggtggaaaaaattttacgacagtatttggaggtacttttatgataaaaacagcaaggcagcttaaagatttaatacgaaacctttccagagaaaaatccgcagatgctcagattttaatgaggaactacatgatggagcgttttttggagcgtatttctctttctgagtatcgtgataagtttatcttaaagggtggtatgttggtagcggctatggttggattggatgcccgctctacgatggatttggatgcaaccataaaaggagctaatgttaatgtggaggatattgagaatctaatttcatcaatcgtaactgttccgattgatgatggtgttaaatttcagctgaaaagtatttcggagattatggatgaagcagagtatccggggattcgtgtcagcatgagtacaacattcgatggtgtagtgacccctttgaaaattgatatttctacgggagatgcaatcactccaagagaggttcggtattcattcaaacttatgctggaagatcgctccattgatatttgggcttataatttagaaactgtgctggcagaaaaactggaaaccattattaccagaaccacaaccaatacccgcatgagagatttctacgatatttacattttagaacagctgcatggaaccacgctgaacccgaaaattttacatgatgcgcttctggcaactgctcataaacggggatcggagaagtatcttaaccaggctgaagaagtttttgacgaagtggaaaatgattcggttatgcaaaaactttgggaggcataccgtaaaaagttttcttatgcttctgatttggaatgggatgtgattatgaaagcaattcgcaggttatatgttctttgcgagaagggcatcagcttatgaaaaagcatggacactattgtaaagtttgtggtgaatacaaagccaacgaaaaattttcaggcaaaggtcatgcatcccacatttgtaaatcctgtgcttcgctaccagcagaaaagcaggctgaactgatgacactgaatcgtcttttgaatcttccatggaggctatcgaaagagcagttgtcctggctgaaaaatcgactaaaggataggcggcctgatgtccgtgcattggcgcaagagcaatatgaaatgagatttccaccaagacacttagaagatgatgagttcaattttttcgatgaagaaagttttatagaatagtgaaagcggtctgctatggcaggccgttttcttttcgggaaggaggtctgacctatggcaaccacgagaatcatgccgcttcatgtcggcaagggccgcacagaaagtcgggcgatcagtgacatcatcgactatgtggccaatcccaaaaaaacagatagcggcaggcttattaccggctatgcgtgtgacagcaggactgcggatgcagagttccttctggcaaagcggcagtaccttgccacgaccggacgagtgcgtggcgcggatgatgtgattgcctatcatgtgcgccagtccttccgccccggtgagattaccccggaagaagccaaccggctgggcgtagaatttgcaaagcgttttactaaaggcaatcatgcctttgtagtctgcactcacatagacaagtcgcacattcataatcacattatctggtcatcggtcagcttagaatatgaccggaaattccgaaacttttggggcagcaccaaggcggttcgccggttaagtgataccatctgcattgaaaacggactgtccattgtagagaatccgaaacttcacggaaaaagctataacaagtggctgggagatcaggcaaagccctctcaccgagagctgcttcgtgtggcaattgacaacgcattatcacaaagtcctgctgactttgaagaactgctgaaactgttgcaagagtatggttgtgaagtctcaaagcgcggaaaatcgtatcgactgaagctctctggttgggagaaagccgcccgcatggacagtctgggcgaaggatatggattggaagatttgcgggcagttctcttagggaagaaagcacataccccgcgaaagaaaacagtcacacaggcagagccgccgaaggtcaatctgctggtggacattcaggcaaaattgcaggctggaaaaggcgctggctatgctcgatgggctaaggtgttcaacctcaagcagatggcgcagaccatgaattacctgtcagagcacaacctgctggagtatgcggttttggaagaaaaggctgcggctgccacggcacatcacaatgagctttcggcgcagatcaaagcggctgaaaagcgcatggcagagatcgctgttctgcgtactcacatcgtaaattatgccaagacccgtgaggtctatgtggcataccgcaaggcgggttactctaagaaattcagggaagaacatgagaaagaaattctgctccaccaggctgctaagaatgcctttgatgagatgggcgtcaagaagctgcccaaggtcaaagagttgcagacagagtatgcgaaattgctggaagaaaagaaaaagacctatgccgagtaccggcgttcccgtgaagaaatgcgagagcttttaacggcaaaggccaatgtggatcgggtcctgaaaatggaggtagaacaggatgttgaaaaagaaaaagaccacggccagcggtaagctggtcctggtcaaaagcgttcgcagaacgcgtagccacagaatgaaattctgtgttcaaaggggcttgggggcactgccctcaacaagcagtttgtggcgaaatggatagccacaagcattgcttgccacaatatgctgcgcataaaataaaaaaccaacgacgggacatttactgcctcctatcgttagttttctgtgtttaagcgacttataaaaccaatcagcataatcagatcgtcatctgacatctttctcattccgtccaaagccttcttgataagctgagggttattttcctgtgcatcaaaaaattgaagcggtgtgatttcaaaatattcacagatgttgagaaactgcttcatagacggcatagaacgcccagaagaaatcgcctgaatatagcttctgttctgccctaactccatgctcatctgatattctgaaacgccttttttcaatcgtaattctgtgattcgattgcggataaattcttcgtccatacgctcacctctctgctcttttagcatagcagaaagcaattcttgatacttcgtatgtgttgtgttattattttataatacaacctttatacgcattattatttgcgttatttttgctttatatgcgtaatcaaggcagttatcaagggtgatttatatgaatcagtatgcctgcgccattaccggccaccgaccaacaagattttgctttggatataatgaggaagatcccctatgccaaaaattaaaagaatgtctcctggagcagtttcggatacttcatgacgagaaatttgtccgtactttttttgtcggcggtgctcttggtgtggatatgtgggctggagaacagctgctgacattgagggcacaaacgggatacgaagatattaaaattgtcgttgtagttcccttcatcggttatgactctaaatggccggatcagagtagacatagattgaaaaagctgatccaaaacgcaaacgattccattgttatttcacattctgcggatgtttccagttataaaaaaaggaattactatatggtcgatcatgcagagtacctcatcggtgtgtttgataatcagaaaaagctgcgttcaggcacagcacagacagtcaactatgccttacatcagggaaaagtaatctctctgatccatccagacactatggagataacagcccctgcgccttaacaaattcacaaaaatttttcattagcatttccaacaaaatattttcattgaaggggtgctgtgatataataagatataaaactacgctcagaataaatggtgccgctatgaacaaatatattggacagcaatttgctgctttaagatacgaaaaaaatattttggttgttgaagaaactacatctgctggtggatgcggctccttcaacgcggcttcttcatgtcctgcgtcagcctgtctttatgacagtgcggcgtggggcttttttattgcctgaaaggagtatgagaacatgagtctgaaatatacctgccccagctgtggaaccccattgggttatgagggattgtgttggaaatgtaagtgcgagcaagaacggcaagctgctctggcctggatgccggaacaaattgtcgaaaaacaaagaaacttgatacagaacatccagaggctggctgatatggaggacccagagttcgccgacttttggcagctgcttggctaccatgatgccatcaccccggagattcagcgagtggcactggccgcagaggtgttctggccctgtgagatctattatcatgctcccgccgatgtgcgggatggtctgatccatgcgctgttgtccgcagaatattccagcgcggcctccaacctgatgagttgccttgctatgcaaggagatgacaaggcaatggagactctgctggagctggagcgaaatccccggccctggcgcaagggcctctatgtagacccatccagctatgcgcagatcggaggctggaccttcgacaaggagggccagaaaatccagctcaacttcgatacctgctatcctatggtcaaaggaaccaccagcgagaaatctcccgtccgcattggccgggcacgggaggacacatgcccccactgtggcggacgcatggtggacatgctggtgctggatggccgggatgagcggctgaaatttctggggttggatggtattctgactgccacctgctgccccaactgtgtgggattcttgaaaggtccagcctttaacagttttaccctggatggcggcgtggaagtctttccctccgagctctttgacggggcggagaaaacggattgctatgtcagtcccgaggactacaaggccctcacggaaaatccctttgtgctgggcgaagcgcccgtgcccctgttttacggtgcggcctgccaggatgtgaacacggtgggtggctttgccaactgggtacaggacgcggaatatacgacctgcccccactgcgggaaacctatgaaatatctggcccagatccagtgggatacggtgtttgactgtgcggagggcacgctctatgtggaattctgcccggactgccatatcgtgtccatgcagcaccagcagacctaaaaaagtcgcacggtatgaaaagagaaataccagcaggtatttgcgtaaggaggaagtagaatgaacagcgaacagatcacagcatttttgcaagagcattggtacattgcctcggtgctcatcggggccgtgattttaattggagcaatccgcaactggaactggctctgcgaccccactggtacgcgggatgcccaccgccacagcagaggataccggcgggtggtgttctttctgttgggtgtcctcctgattgtggtgagtatctggggatttgtgctgaagttgaaataggaggagcaatcccatgacccaagaagaacagatccgactctatcggctgatggaaaaactcaactggtttttccaccaagagatgcactacctgaatagagatattgcggaaaagaccgcacgggagtgttacccggagattcgggattttacatacgatattttgtggaacgacctgcccagagaggtgcagggacaacttatgaacgaggatgagacgctatgaatactacgatgactttagaacaactgcctcccaagggtgtaaagcgagaacaggccattttggcgctgggcaaagaggaagcaaacggcgaactgcttctccagcttgtgaatacagaaaagggcaagtgcaaaacggctgctcaaaaggctttggcgcagctggagtatgcccctgctgccccactgtgggccaagctggtcaagggcaaatggatgggcagccatatcatgtcggatgcctgctcggattgtgtatcggagcagattgccccagtcatcctgaaaaccctctccctgctgttggatgaggcggatacaaaaccgctggaagagggacaggtggaacagatgaatttctgttttcatttgatgctgggcaaagcctcccccaagatgttggaggtgtaccgttttctggcggaaaatgcggaacggatcggccatctcaagcacacccccttttatgatggtgacaaatgcactacatggcacatttcccaaggactggggctctataaagtaaagccaaaggaaatggagaagattccggctttgattctgaccgcctccttgattcgaaacccggatacacgactacaagcactggccgatgaactatatgaacgctatggcggcagttggctgattccagtctttatgaaagcaattatcacccagcccaaggaacaggtgtatgaaacctattcgctcctgctgggcactcccaaagaaatctacctgttcaatgctctggggatgctggattaccgctgttatccggaggactggatctatgaacgcctggggcctgatggaatgactgcgttcatcttttggggctatgaccgctacgggtcctatgacacgacctttatgtttgaacgctatgtggagctggatgagcggtggctttttgatctggccaaagaccctgaaggtcgaaagcctacggtgacttggcaaagttacaaccggagtggtgttctgtacgaaagctacgacgaaatgttcatcagtctgctgccccgcaaggtggaaaacccggaactgaagtgcgttctgcgggactacttccgcatccgcagccagaaaaagaaagtggctaagagcatcaccgtttaccaggatgctgcggagcgattcggagattaagcaggaatggagcgactggtatgatcggaacagatgaaaaccgggcagtgctccatgtggaggtcatcttctggagcggcaaacgaaaaataccgcccagcctggtcagcgggaagtaggaggacttgctatgaacgaaaaactatttcgcacccaatttaatcaaatggaaaccaccgagaagcaggcgctgatggaaagcctggctgctcgttatgatatgacctttctcggtctacatacctttgaccgctggggccagaactgcaccaccggcatcttcaagaaagatggccgggagttcgtctttgtccccggcgataccgtcaccctgggctgggagcagtttgccgtgggactgaatcaggagagccgggaggaattagagtatctgttccgggaatgggaaatggaaccgcagaacccggaggagatgatccgggaaagtatggctcccgttcggcaggcggccattggccccatgctggtgggccgggagctggaggaactctgctgggagccagtcaagatggacgatcccaggctgaccgcccaccctgactggctgaaggaatttcgtgattttgcctggagtgacagcagcagtcttaccttgcatcagtcggcccgcattgagcggacggaaaagggctttcagatctgcatctataaccgcacagactacgatgcgcttcttgccgggctggaaaagcaggggctttcgctgcctacggcggacgagtggtcctacctgtgtggcggcgggtgtcggaccctgttcccgtggggagatgggttagactactccatgcgtctgcgctggtttgaggacatggatgaggatgagaaccggccctatgacatggaggaacccaacttcttcggcctgtccatcgcctacgatccctatatgcgggaagtggtgcaggctgatagacttaccacctgtggcggcgatggcggatgcaatatctgcggtgggctgggcccatttctcggtttcctaccctgttcgccccactgtaagccggaagtgcaggaggacaatgaactaaacggagattatgacttttatcggcctatcattcggctggagaaccatgattgacaatagaagcttgatacaaaataaagaaagagaggtgccgacatgggagcatggggcataaaagcattagagcgtgacgaagggctggatgtactggacatcctcaaaaatgaatatgtaccggagcatccggtaatggatctgggcgagatgatcgaactgatgaaagaggaagtcatgctgggagctgacttctcacaaatcgacttcctctttgacaatactgcgatggctctggcggagctgtatttccaatggaaggataatggcaagctggactacgattatgaagaagctatatgggataaagtcaccggtttcacagcatccaaagaagcccttgctttcctgctgcggcagctcaccgacatcaaaaacgaggtgccggacgaggacggcatccgtgagattgtggatctttggaagaacgaggacagcggtgagatcgctcctgtgtggtcagagcatttggactggctcatcaagcggctgatctcggaacaggaggcatgacgcatgtatatcaaaaaatactggggcaactttatcggaggctcggacgacagcctgaaccttatggcatttttggaggatcagaaacaagaggagatccccctcagcgagattttcgccaagattggtctggacaagcagaactgggacttccgccagaccgtggagtatctggagttcacccattcggacggcgtggagatggacttccacttcgccattgatgtggtcaccgacctggccgccatcctgctggagtgcagcgtcagtggcagtgtaaaccttcaggatctggacgagtacaacacccccgcccgccgtatccgcatcactgctacgccggaggagcacgaggccatggacaaggccctggcggactttgtccatgccccgctggaatacgacatcagcgagatgatgggcgaggatgagatcacggatatggcttctcaggtggagatgctgcggaaggagctgtacgaagcctctggccgcaaccggaactaccatgtaaaggcggaagatgtaaaagatctgctccccgactgggagggtgccgatggctgtatcgccaccaaccgcatcacagtggagggctgcaaggttggctactgctacagggagaagccggacggcggctgggacagtggctggcgcttcaccgctggtgacgagagcgaggcgtacatggacgaccccaacaacgccgggatttacaagctgaacacaatttgcaacgacgatcccgacatcattcctctgctggacacccccgccccctgcgcctttgagcgggatgagaacggagtgttccagcagatcaaaaactggaaaccggatgaggacgaggaggaccctgatatggacattttgaagcagtgccagaagtggcatgaggaggacaaacacctgaaaatcgttgacgcgctggaggccatccccgccgaggagcgtaccccggaaattgatatggagctggcccgcgcctacaacaatctggcggaccccagcgagccggagggaaggaagctgcttcaccaggcactggaactgatgcagtcccatgaggaggaactgggagatacttattcctggaatttccgtatggggtatgcctattattatctggatcaggagggccgcgctctgcggcattttgaaaaagctctggaactgcatcccggtgatgatccgaagctcaacacccgacaggacatggaggaactaattgactcgtgcaagaagggtatttctctgcctcagttctcggagtgcttccgggaaaggacagaggactggtgggaaacctttgccgagatggaagcagagctgcgccagatgatggacgaggacaaagaccatacccgcggcgcagaactcgtggcccaaatgcaggaaaccctgaatctggtttttgatgaaatctccttcgagatgggcttcaacggcgagaagtacgagctgatcctcactccggagggtgacaaggtcaagctgtttgagctggtctacttccagaaacacgcctccaaggaggtgctggagcactggaacatccttgtgggccgtcagcccctcccgaacatcggcctgcgtaccgaggacggatggaatatctctggggatgatgtgcagatctggctggaggaacagggtgaaaacagcttcgccatctccgcttactgtgaaaagctgctgcctaagcttcaagaggaagaaggccgggcctggtggatgctcactaccctcaccgaccaagtgctgggcgagatctcccacatgagatacatagacagctttgatgtgctggaggaacccaaggcagagccgtccttcctcctgtcccagctgcccgacaaactgcgggagcagggcctggagctctccaccgacccggaagcctatctggagagctaccttggttacaaaatggaacccaaacaggacccggacgccgattggcggctggatgtaatggccggttccacctgctgtgtgccgctcatcaacggctatctgaatgccgacaatgattttatggacgatctccatgccgacggcgcggtggcgggcttcttctgctatcccctggataccctgcgggaggaggaaggcagtcagaaaattttcgacttccgggacaaactggaggaagtgctcaccggcggggatggttcggaagtgctcactctcaccggcggggctaccggcctctactgtggctatgtggacttcatcgcctgggacatccaagaggcgctgaacatggcgaaagagttctttgaaggcacggacatcccatgggccatcttccacaccttccgccgtgaagccggttctgtacccctaaagcaacaagatgatgggacagaaactgagaatcaggatgacgagttggacgaaacgctgacgggcatggactatattccttacacccaacagaacgccgaagcattcttcgctcagctggagcagtggaacgacgaagacgagtacacccgctgtatccaggcactgaatgccatcccggaggactggaggaactatcgcaccgcctacgccttggcacgggcgctagaaaactacgccattatcggggaccatgacgagggcacccctcgctataagggagacaaggccctgtgccgcgccatcgaggtgctggagtccgtccgggaggaaggccaggacaaggcggagtggaatatgcggatggcctacggctatcagtatctctatggtcaggaggaaaaggccattccctacgcccagcggtgggcagagttggacccggaggacgaaaatgcctcggcggtgattcaggagtgtaaggcggagatccggaaacgccagcgcagccggaagaaggccaaattcgtgcccggtgatacccccttcgagggcttcgacctcaccaacttctgggacgacagtatgtatgcgctgaaagagtatgtcagcgatccgccttccgatgagctgatcgccagcgtggaggaggaactgggctataagctgcccgccgcctatatctggctgatgaagcagcacaacggcggcattccggtgaatacctgctatccctgcgatgagccgacctgttgggcagaagaccatgtggccatcaccggcattttcggcatcgggcgggaaaagagctgctccctctgcggagagctgggaagccagtttatgatcgatgagtgggagtatcctgccatcggagtggccatctgcgactgtcccagcgccggacacgatatgatcttcctggactaccgagcttgcggtccccagggagagcctgcggtagtccatgtggatcaggaaaatgactataaaattacccatctggcagatagctttgaggaatttgtccgcggactggagcatgaatccctctatgatccggatgaagatgtagaggatcttgaggatgacgccgacgaggagaaaactgaccgtaagggctcctttgccgggtctgtgctcctctccaaagcggaatgggacaaggagcagttgatccggaatctacgggaagaatggggcatcgtagatgaggagccggatgagggcgacgaagatgatgagaacagcgatgacgctgtggtaatgcgggtcggcggcatgatgctgatcgtgacactcttccacggtcacatcccggacaatgaagcggagatcaacgccgaaaacaactatatgtggccagaggccgtagaggtggccaaagcgcacaaggcccatatcgtggtggctgtattgggcgaggaggaaaaactgctggaacggggtaagctgttcactaaggcgatggcagtgtgctgcaagcagaaatatgccaccggtgtctacaccagcggcgtggtatttgagcctcgtttctatgagggccttgccgatatgctcaaagaggacgaactgcccatcttcaactgggtttggttcggcctgtaccggagcgaggggggcctaaacggctacacctacggcatggatgtgtttggcaaggaggaaatggaggtgttgaacaccgacgctgagccggaggaactgcgggactttttggccagccttgcctcctatgtgctggcgtgtgatgtgacactgcaagacggcgagaccatcggtttttctgcggacgataagcacaccatcacccgcagccccggcgtctccctgccggaggaacagatgaccctgaagatcggttacgagcctataaagggagatccggaggatgacagctgcgaccactcagacaatgatgacacgcaggatgaggaagaattcagtaatcccgaagtctacaccgaggaggagatggaagccgtcgaggggcacattgagcagtatttcggcaagttcgagaatgtgttccatgagctggtttctcccgacatccatgtggacatctgcgtggtgccgccctctgaggagcgggactactgcaccctggtcaccatgggcatgggcgctcaccggatgaatgtgccggaggaactggcggaatataagctggagcgggcggagctggccattgccctgcctgcggactggaagctggatcaggagtccatgaaagacgaaaagtggtactggcccatccgcctgctgaaatccttggcccgccttcccattgccagcgatacctggctgggcttcggccataccatggacaatgaggaggattttgcaaaggacacaaagctgtgcgccgccattctgactggtccccaggataccgaagatggcagcgaggtctgcatcctgccgagtggcgaggaggtcaacttctatcaggtgattcctctctaccgggatgaattggaatataagctggcccatgacgcggacgccctgctgggcaaaatgaacggcatcagctttgtggtggagcctgatcgtcaggatgctatcacccgtggcaccctttccaatgatgattttgacggtgagatggacgatgcctcctatcatatcgagagcattgaggagaaggaactgccaattgaccccatcaacgcttataaccacatggccatctacctgcgctggtgcatggagcacgacctgatgggtgaggacttcctgaaagaatacagcgaagtggccaaacaggtcaaagctgatcctgccagtgtggatctgcgggagtttatccgggatgagctggacggctgtctgttctctgtgttattcaatcagcaaggccgtgcctttgcaggctattactacggagagggcgacagcccctactatcctgccgatgttgacgacaacgccctccgcttcttcggcccggagcggtatcactctgatgagttccaggatgaagcctacctgttcatcccctttgacgaggactactatcaggctatggcagaggtgatcggggaacggtttgaaaactggcagggacaggacttcgacgaggacacgctggagccttccgaggttgctcaggccatcatggagtatctggactgcgagtgtacctatttcccatccatggcagatgatgaccccatcatgtcggcatacagctacgcccagcggctgggggtacgggagggctttgttcccgtgctcatcaaggcggatgatgaaacgctgttggagtgtctggtgatgaacgccgatccggagcacaatgcggacttctacgaatttgacctcaaaacagtagaggagtatcgaaagaagatgctctccgctcccatcaaggacggaaaggcggttctggaggaattgaccggccagcgcaaggaagaagccgaggacgatgacatggactgggaggcggaagtcctgggcgagatggagggcggctatgacaatgaccgcttctcctgctattgggattcggatagccacatgacctatccgctcattctggccaaaattccggtcaagaacccctgggagatcttcgcctatctgccctttggaaattggaatgagtgccccgacacgccggacctgatggcagtggcgaaatactggttcgagcagcatggtgccatccctgccgccatgagccacgatgaattggagtttgaacttccgactccgatctccaaggaaagagctatggaagtggctgtggagcaatatggcttctgcccagatctggatcagaatgaggatggaagcattggctccttggcagatgtcctgtggcagtccactgtctggtatttctggtgggattgatgggaggtgcgaccaatgacagaatatcagaaaacctatatcgaactaaaaaaacagtttgttgcgaccaatgaaggtccagacaatgtccgcgctctatataccttcaaggaagaacttgagcagagtgaggatcagcaggccaaggaagtgctggtggatgtatatgacctgctggactttaagaaggacgcctacgaactgctctgccaaatcggaaatcgttccgataaaaagaccctcaagcggctgggcacgctgaaggactatgcggaaaactggggcaatcattatgctctccccaagcccaaaacgccggaggaaaagcagaaagagaaggaacggcaggcccagctgggcctgcccgccttccggtatcacccaaaccctctggaaactggggcttttgaggaatccgcagacggcgttgtctgcgactgctgtggcaagacgacccatattttctatacagcccccttttacgccgtggaggatattgcatatctgtgcccagagtgcatcgccaacggcgaagcagcccggaaatatgacggtagttttcaagatgatttctctgtggatgatggtgtagacgatccggagaagctggacgagctgatccaccgcacccccggctactccggctggcagcaggaatactggcgcgcccactgcggcgactactgcgcctacctgggccatgtgggtgccagggaactgcgggccctgggtgtgctggaggaggtactggacgatccgatgtgggacgatgagcaaaaagaaatgatccgggaatctgtcaatggcgggcatctgcaatgctatctgttccagtgcctccactgcggaaaacacctggtctggatggattttgattgaaaaggagacattactatgggacttgacatctacgccgggacgctgacccggtactattctcacaactggaaaactgttgtgcagcagtgggcggaggaaaacggatactctttcaaccgcatcaccccggatggagaacccgccgacaacgaggaggagctgtcctcggccgaggttcaggcggcggtggagaactggcgggatcagatcttagccgccatttcccagccgaaccaaccgccctacactccatggccggaggacaacgagcggccctattacaccgataagccggattgggatgcctttggcgctatgctgctggtggccgcctgtcgtacatacgaggaaccggtgccttccaccgtggagaaggactggatcttcggggagcatcctctggtcgcccgccttgcatcagatgaggagcgggtgtggtccctgtttcgtggggctacctggtggctccctctttctgacagctttctgttccaagggtccttgcctaccgatgacaccgccgctatcgccaccttgggcggactgcggaaggagctggaaaagctgaaccagctggcgtggcaggccgatgaggacactatccttggctgggcagacacggagggatacccggtagacggaaccgtagactcagatggacagtacagcaaggcagacatcccggaacacacccagtatgacactcaatcccttgccaagtttgccttctccatgttctggcgggccatgcggtttgccgaggagcagcaggtgcctatcctgcttgactattaaagagaattcgtcagggggtggagaccgtggaacaaaaacggccggcagatataattcaggaacttctggactacctgtggaacggcctgggcctggaggaaaagggctggaagcgtctgaaaaagggcgacttcaaaaagaaaatgaaaaacgggctgacctatcagatctggtttgaccggagccgctacaattacatagactacgaaatcggccatgggaatgtggaggtgggcttcagctgtatcataaggcagggagatgactacctctactctttcagaattgaacccacaacaggcggttcattctttcggatgctgacagaggacctgcggctgaacaccgggctgctggacacctttctgcccctggtcaaagccaactacctcgacttcatcgaccgcttcgaggcagaccccgtggaggcattacagccggtctgcgcccccttcaccgaggcggaggactacagctggttcatctatgtgcgggagcagatggtggaacggtacggaacggcggagcagatggaggagtaccgccgtcaggcggaattgcgcggaacgcctggacacaaggcaaagaactggatgggttcgatgttgttccacctctcccacgccaatgatgtggatcaagcctgggcctcaagccgcaccagagaggaactggaccaggtggtggaaccctttgtgcaggccaagcggcagacaggacagtggacacaggaggatgaggcgggctatcagctctaccggcaggaaacagatccgaagaagcgcacctttcgggtatggtatctcatcgccaacccccgcggcctgccgaaagagtttgtccagaaagagctggagtttcggtggaaactgttcccagaaaagaaggcggaacccaaatgagcaataaagctttccagcaaaatctggacgacaaaaaaggcccccagcccggaggtccctatctcattcagatgctgttcaaagagccggtagaaatgccggataaagaaaaaatgactgccataatggagaagcacatcggatcaacagagtgcttctgttatgataagaaaatggccggctttgccgccctggatcatgtcgcggaatttcaggacggcaagtgcccggtacagctgatggtgatgaaatgcgacaagttcaagggcaaaggctttgatgcctttctgatgagccagatgtgggactgccaggaggaccgtgaccggatcttccgggagtgcaaatatcaggtggtggccaccgatatgctgactgcggcgcttccagcgctggagcgtgccaacctggatgccgactttctggaggctctggcagagctgtaccccacctgtgaggcgttctatttccagaactgcggcaagctgtttctggcagaggatgtgcgctcccatcagattgaggggccggatcggttcatccgctttggcgtcaatgtccgtttcttcaacatcgagggcacggaggatatgctcatcgacacggtgggcatgagcaccctgtttttgccggatctccagtaccacttccacggcatggaccccaactgggtggtaaaccacgcctataatgcagcgtcctatattctggagcatgataaccccattgaggatggggaaaccatagacggcgtggcggatggtcagatgtgccgggagatccagtggaagtgccaatatgaagatgccttgatccagccgcccagaggggtgctggacatcaacatgggaaactatgcttcgggaggacgctgaatgaatggcgttgtgctcctggtaggcggacttctgcttgtggcggtgatcaagctgattatagatcgaaattggatcggcctgcttctctgtgctgtcgccctgcttctggtctttggggctggacaccatacaaaataggccattttaagaatcgaggaggtgaagtatgcagaattcaacaaatatgcggatactggaattactccggtttctctatgagcggaccgatgaaaaccatcccgccacagtatctgacatcattgcccatctgaatggaaaaggaattcaggcagtgcggcagactgtttacgcagataccaatgcgctgatcgatgcggggattgatattgtggtggttaagagtacccaaaaccaatattttatgggaaaccgcctgtttgagtatccagaactgaaaatgctgacagacgcagtagcatcctcgaagatcatttctgccaagaagtctgaggagctggtgcagaaattatgccgtctgaccagtctacatcaggcaaagcagcttcaaaaatttgctgctttatccagccgtgtcaaaccgcataatgaaaaggtttactacatcattgacaatatccaaacagcgattggaaaccatcagcaaattcggttccaatactatgaatatactcaagaaaaaaagaaaatcttaaagcatgatggatattattatgtcgtaaatccttatgcgcttgaatggaaaaatgaccattactatttgattggattttctctgaagcatcagaaaattgctcacttccgtgtagatcggctaacaagtgtagaaaatctggaaacttactttatgccgatagagggatttgatgtagcctcctatacaaataaaatggttgatatgtttacatcggagtcatcgaaggaagtaacccttctatgtgaaaacgaattgatgagagtaatcatagatcattatggagaagatgctgctgttgataggtatgatgatacacacttcacagccaaaattgaagtgaaccccagtggaactttttatggctggatattcaaattcaaagggaaaataaaaattctctctcccaaagagtgcattacggaaatgcagcaaatcgctcaggaatttatatagcgcaaaagaggtgttattgatttttaacacctcttttcaaatgaaatttttatccttgaagtgaacggatgttcgatatacaatataagcaagatgttcgcagttcgtcgaacaaatgagaggtgaatgctgtgggcaatataacttttggatcatttatagccgagaaacgcaaggcgcacaaattcaatttacgcgatacagccaagcatttgaatattgcttacggttatctgtgtgatattgagcaaagccgccgtcctgcacccaatggagattttgtggaacgcatctctgcctttctgaatttggataaatcagaacatgagttgcttttggatctggctgcaaaatcacgcaatacagtatctgctgatttgccagactatatcatggaaaaagatattgttcgggcagccttgcgtgtggcaaaagaagtagatgctaccgatgaagaatggcagacatttatgaaaatgctaaaggagcgtaaacgataggggggagagctttgtcaattccacaaatccgtacagaagcaatcgaggcagtagggcgaaaaatcctgatggaatatgatccctctctgctatccgggcaaccatgtcctgtgccaatcgaaaccattatcgagacaaagtttgatctaatcctggagtttcatacactaagaaaaaaccccaagatattaggggaaacaattttcgatgacggtgctgttgtcttatatgaccagatacagagacagtatcgaatgattgcagtaagagccggtacaatcttaattgatgaacggctttgtgatccgtcaaaattagggcggctccgttttacctgtgcccatgagctggctcattgggtactacataagaagttgtactccggtactggagatgttgctgcttataacggaaatgtttcttccgacgaaagtcatggcataattgagcgtcaggcggatactctggcttctgctctgctgatgcctttaccgcagatcaaaaaatgtttttaccggcttaaaataggccggacagatgaacagctcattgctgaaatggcaaatatttttgaggtttccaagcaagcaatgcagattcgtctaaaatccagaaacctgatataaccaaatgggggaatagagagaggcactgccctctctcacgctcctctgctatgctattttgtacctaatatgttcgcaatattgcgaacaaggagggatgttctatgagaaaagaaagcacaacaatccaaaaatgtaacagcaggctaacagctttggggcttaacagcgacgctgcgtttcatagaagtaagctgattctaaagatttaccgtgatgtagtctgggttctgagtgaacgggcagaagaattacaagaaactgcttggattatgggagaacaagatatagagtctggcctctgctatcttgaaaattttgcaccagatattgaactgcaagcctttgaagaaaaagtttgctgccttgttcaaaatcaaatgctggtcaatattattgaccgtgcactccttcgtctgaaacggtatccggatcgaggagaactttactatgaaattttgactaagcaatttatctatcggttcaacagtacagagaaagaattgctggaagaactaaatatagagcgcagtgtcttttatgaccgaaaacgagaagccatctatttattttctgtttgcttgtttggatattctattccagaagtcctggaggagctgccccgactaaatcccgactaaatcccgacaaatccccgacctaatccctactcccttccgacttccgacctgctatacttgttatagtggcaggaatgcgctaaattgaatacttttctacataaggcccggcattaaccgggcttttttcattcctgctgcaatatggcggcaggaacatggctggaggtgaaaacacttccggcctttttctttgcccggtattaggaggccggtatgcgctgggaggcgtacatagcaaaatatccatgacaccgttcaaattcgctgactaccaagaatttgaacggaggaaaggatatgacgagagtattcatttggaaaaataacagcccacaggaatgggaggaaatcagtttttcagcgttcagtaaggcacgccgcaatggttgctttactgggcgcttttttgttgaaacagtcaaaatgttccgtgatgaagatgaccgcattatcatggaatgttctcgcaaagattttgaaaaataccaacaggaggaccgccacagccgctatctccaggaacatgagaaaagtcgctctatattcccggcttctcatgtgggagatcgtgacggcacagaggaaggttatcaggatacagatttgtttgtggatgaatctgttgatactgcggaacaagctattcagaatttacttcttgaggatttacaccaagctctattgaaactgagtccggcagaacgagattttatattgtcctattatgaaatgaaaataccaaatgcaacttgtttagcccaacgatatggtattactcggcaagccgcagataagcgattgaaaaaaattgaagaaaaaataaaaaagttggttgcgattttctaaaaaagtggcagtagcaagtgagagggaaatcctttcacttgcaccttgacaacctcatatacgaatcattaagtttgatcctctttgggcgtaatagccgctacatcagcggtatattttctgagagctgccactcgcataacaggccaacccatttttgctgtatagatgagttttcggtttatcagaaatatatcaggctggaatacatcggatggcatccggtcatggcataacaaggaggaaagctctcttacagccatagtccgagcgtgataataaccgtcgcaggccatgggtaagaccaaacgaagtggaggtgaaactcctgagaagcaggccagccacctgcggcttaatgattacccaaatccctggggtgtcgtggacaagtaagggataaaacaggcgctaaattgaaggagactctgtaatttgcagagcctccttcttacataatcaaatctcaaaacataggaggatgaacatgaaagaagattggatttataagcgtggggatttatattatgccaatttgaacccttattttggatcagagcaaggcggcacccgtcctgtcctggttcttcaaaacaatgtggggaattttttctgccccactttgatcgtagctccactcaccagtaaatggattaagaaaaaggagctgcccacacactatgcactggagagcgttccagagcttggactgaaatctgttgttctgctggagcaaattaaaacgattgataaaaggcgtgttttatcgtacattgggcgcgtatctcgcgaagaaatgagagcgattgatgatgctctgcaagttagtttagatattcatattccggaggaaatggaggctccgtaaggccacttaccggataaaggaggcgtttttatgtttgaagcaagaattgcggaattgaaccgctttaatgaacaaaatcctgtcagctatgacaaaagaacctatacggtcgatgagattcaggacattctgggtatcagtcgtcccacagcatataatctggtaaaacagggtgtattccacagcgtcagagtcggcggtcatatccgcatttccaaaaagagctttgatgactggctggatcacgcagatgaatgatttgtcaaggatgccgatctccaaatcgacatccttaactttttttctgctttctcttacaatgaggccatagcaagaaaaactttatagaggaggcaaaagccatgcaaaaacaaagagtaaagaccagtatgtctgtaccagagatgggcaaaatgcttgggcttggtaaagtagaatcctactggttggttaaaaagaactatttcaaaacaattcaagtggccggacgaatgagagttatgctggatagctttgaagattggtatgccggccagttccactataaaaaagtggatggtacaccgcccggagagaaatggaggcatactacgatgtcagttccggaaatggcggatcttttggggctgaaatctggcacagcttatgaccttgttaaaaggggctattttgagacgaccttgattgatcgaagaattcgtatcattaccagcagttttgaagcctggtatcaaaagcaaactcattatgtgaaaatctcagaaaggagcaatgaaaatggcatctatcgtgaagcgtaaaagcaaatattctgtggtgtatgattacacagatgaaaacggaaaacgcagacagcgttgggaaaccttcagcacaaatgcagaagcaaaaaaacgaaaaaagcaaattgagtatgagcaggactctggaaccttctttattcctacggcaaagaccctgaacgatctgctcgatgaatatatgtccatctatggtgtaaatacctgggcaatgtcaacatatgaaagccgccgtggtctggcgagaaactacataactcctattatcggagatatgttactatccgacatcactccaaggatgatggataagtattaccgtgatctgctctctgtgaaaacggtaagcgtcaacaaccgcaaacccacaagcgaatatctgaccccgcatacagtaagagaaattcacaagctacttcgcagtgcctttaatcaggcggtgcgttgggaactaatcagccgtaaccctgtcctgaatgcgacacttcccaaagaagaacataaagaacgggatatatggactgccgaaacgctgagcaaggctatggaagtctgtgatgatcctatcctctcccttgccttaaatctggcgttctcctgctctttacgcattggcgaaatgctgggccttacctgggactgcattgatattgcaccacagagcatagaaaatggttcagcttatatattcgtcaacaaagagctgcaacgggttacacgaggtgcattggacgatttgagcgacaaaggtgttattaagaagtttccaccttgcatagccagtacccatactgctctggtcctgaaagagcctaaaaccaaaaccagtattcgccgcgtgtacctgccgaaaacagttgcctatatgctggtagagagaaaaaaagaaattgatgagctgatggatctgtttggagatgaatacatcgacaataacctggtcttttgctccagcaatggccgtccgatggaaagtcaggtgattaaccgtgctttcaataaacttatcaaagaaaacggactgcctcatgttgtgttccattctcttcgccactccagcatcacctacaagctgaaactcaatggcggcgatatgaaatcagtccagggtgactctggtcatgctcaggttaaaatggttgcggatgtctattctcacatcatcgacgaggatcggtgcataaacgctcagcgattggaggaagctttttattcctctaagactcctgaccctgttgaagatacagagcctaaaactgcggatactgccgtcactgaaagagatgaaagtgatgcagcgaagatactggaactgcttaaaaatcccgaaactgccgcactgctcaagcagctggcaaaagctttataaagtccctccctcagaagaacgcctctcactttgtgagaggttttcttcgtttgaaccactttgcacagtgaccaaacactttttttgttagcaaggttctgaaagcatttttgagcgatgttagcaaattcgcgattttgtttgcaacttcctctaatttctgctaacaaatgtttgcaagttcctttggtaaaaatcgaacctctgacttaccgcctttcttagcaaaaggccaaatctcgttagcaaatgttagcaaaccaaggttttttgcaaaaaagccacaaaagccgcagaaataagaaaagccgaaaaccctgataaatcaaaggttttcggcgtgtttgctggcgtccctggcgggattcgaacccacggcctttcgcttaggaggcgaacgctctatcctgctgagctacagagacttatattaaattgagactggcaacgatcacttttccccgtaaggcagctggtagagcacaaccttaggaggcgtgtgctctatccagctgagctatatggacgtgtctgatatatgattatagcccgatcaaagtcgaactgcaatcccttatttagttttttttgaggtggccgttgtaacgcaaccttaggaggcggtcgctctatcctgctgagctacaggcgcatatgaaattgtggaaaaactggcgcgcagatgctttgatattgtaccccaattccccgcgcctgtcaacggcaaggggtgtttttgtcccccgatttggacgttttttttgcaaaatcagttgcgcgcgttactgttctacggtataatatgtggtcgagctttcaatgatagggacagatttcggaataaattgagaggtgcaccactttgcaagatacgaagctgagaaacgtcgccattatcgcccacgtcgaccacggcaagaccaccctggtggacgaaatgctcaagcagggcggcatctaccgcgagaaccaggccacggtggagcgggtcatggactccaacgatctggagcgggagcgcggcatcaccattctggccaagaacaccgccgtccactacaaggacgtgaagatcaacatcgtggacacgccgggccacgccgattttggcggcgaggtggagcggatcctcaagatggtcaacggcgtcatcctgctggtggacgccgccgagggtcccatgccccagacccgttttgtgctgagcaaggcactggagctgggccacaaggtcatcgtggtggtcaacaaggtggaccgccccgaccagcgcatccacgaggtcatggacgaggtgctggagctgctgctggatctgaacgccaccgacgagcagtttgagtcccccaccctgttctgctccggccgccagggcaccgcctcctactcccccgacgtgcctggcaccgacctggtgcccctgtttgagaccatcctcaactatatccccgccccggaggcggacacggaggcccccttccagatgctggtctcctccattgactacaacgagtttgtgggccgcatcgccatcggtcgcatcgagcggggcactgtaaagcagaaccaggagatcgcggtgtgcaacttccaccagcccgacgccgcgcctcagaaggccaaggccaccgccctctatcagtttgacggcctgggccgggtgccggtgaccgaggccaccgccggcaacatcatcgccatgagcggcatcggcgagatcaccatcggcgacaccatctgcgcccccgacgcggtggagcccatcgagtttgtgaagatctccgcccccaccatcgagatgaccttctccgttaacgactcccccttcgcgggcaaggagggcaagttcgtcacctcccgccagatccgggagcggctgttccgcgagaccatgaaggacgtgtccctgcgggtcaccgagaccgactccaccgacgccttcaacgtggcgggccggggcgagatgagcctgtccatcctcatcgagaccatgcgccgggagggctacgagttccaggtctcccccccccgcgtgctctaccaggagattgacggcaaaatgtgcgagccggtggagcgtctggtggtggacgtacccagcgacagcgtgggcgcggtcatcgagaagatcggcgcccgcaagggcgaccttctggagatgactccggtgggtgatcggatgaagctggagttcctggtgccctcccgcggcctgttcggctaccgcaacgagttcctcaccgacaccaagggcgagggcatcatggcctcggtctttgactcctatgcccccatgaagggcgagatccagcgccgcaactccggttccctggtgtccttcgagaccggtgagagcgtcacctacggcctctacaacgcccaggagcgtggtgtgctgttcatcggcgcgggcgtgcccgtctatgccggcatggtggtgggcgagacccccaaacaggaggacatctcggttaacatctgcaaaaagaagcagttgaccaacatgcgcgcctccggctccgacgacgccctgcggctcaccccgccccgccagatgagcctggagcagtgcctggagtttctggccgatgacgagctgctggaggtcactcccgaatccctgcgcctgcgcaagcgcctgctggaccacgcggcccgcatgcgcgaggcctccaagaaaaagggctgattgccgcaacatgatttccgcccccggagcatgctccgggggcggttttcagtctgccggggaaacgactactccacgtagccgtgctttacctggtcggagatctcgcagagggccttgctggcctccatgtcgaactggcggcactgggccaggtcccccagggagaccatccccaccaccttgcccccctccagcacggggaggcggcgcacctgcttggccgccatgagccgggtggcctccctggcgtcgtcgtcgggggacaccaccgcgcagttgcgggtcatgatgtccttcacctgggtcttgagggggtcctcctccgccgccacgcagcgcaggatgatgtcccggtcggtgacaatgccccgcaggccgccgtcctcaccgcagacgggcagggagcccacgttgtgccgggacaggagccgggccgccagggaggccgactcgctgggggtgatggagaccacgctggggttcataagatcgcgtacttgcatgacaaaaccgcctttctcccaaactttactgctagtttggacgggaaaggcggttttattcctctttcagcccgagattgcgccgcagagggccggggccccgccaggcgaaggcccgacccccgtacttatcccggaacgtgcggttggtgagcccctcgagatcggagttttccagagcgtctaccagagatgtggaaaactcgggcagcggcgagcgggccggggcggcattgtagggacaggcccgctggcagaagtcacagccccaaatcaacgggtggaccctcagccgggcggtctcctcctccgtcagcgccccctttttctgggtcagctcggacagacagcgggacacgtccgcccccccttcccccagggccccggcgggacaggccgcccggcaggccccacagtcggggcagtccggcgcggcggggcgctccggcacgtccagcgccgccccggtgagaatggtacccagaaatacataggtgccgtagggcggcaggatcagcaggccgtttttcccccgcaggccgatgcctgccagccaggcggcctcccgctccggtaggggggagttgtcggcggcggggacaaacgattcccccgggtatttccggcgcagggcatcacacaccgtattcagccgccgggtgagcacccggtggtagtcctccccccgggcgtagagggacaggttgcccggccgctccccggcgtagtaggggaaggccgccaccaggacagtctctggagcggggcagagggtttccaccttctcccgggcaccggtggacaaaaacggaagcagccgccggaaggccacgccgccccaggcggcggccccggcggctgcgaaccacttatccagcattgtacttgtccagcgcccgccgggccagcgtcccgtccgggatgcagggctccgggccgttcttccgcttctgggcctcctcgcatcccttgcccgccagcaacaccaccgccgggcggagggcgcccaggatggcggtctccaccgccgcctcccggttggggatcacggtgtaatccttgccgtgggcagtgaggaacacgccgatatcggcgcagatggcctccacctcctcggggccggggtcgtcctcggtgaggataatccggtcggcccactctccggcggcgttgcccatgccctcccggcggtcgatgcccttgccgccggtgcagccgaagaggacggtcagctcccggccggggtactccgcccggacggagcgcagggcgttctgtaggctcatgccgttgtgggagtagtccacaatcaccgaaatctccccgtcggcgctgacatagtgctccatgcggccgggcacgaaggcccgcaccagtccggcggccaccgcctcggcgggaatgccgtagacctccgccgccgccacggcggccagggcgttttccacattgaacaggcccggtgtggaaatggccagctcccgctcatagcggggggtgcgcacatggaaggcaatgcggtccccctccttgcgcacctgggcgccgtacacgtcggcggaggggaacttctgggagaaggtcaccacccgggggcaggcggccgccgcggcgcgcacccgctccacatggtcgcagtccaggcagacacaggcgctccgggcctgccgaaagatcagcagcttggagttgaggtagtcctccagatcagggtgctccaccggggagatgtggtcctccccgatattgagaaacaccgcgcaggccagctccaccccgatcacccggccgtacttgagggcctggctggacacctccatggtcagatagtccgcccccgccgacaccgcgttccagaggtggcgctggagatccagcggctccggcgtggtcagcttggcgggcctgcgctccaccccgtcgtcggtgacgatggtggacagcagggcgctctcccggtggccctgtccggccagccaggcatccacgatggacttgatataataggccgtggtggtcttgcccttggtgccggtgatgccggtgatccgcagcgccccggagggatggccgtaggcccggtcggccaagaggcccatggccttccggatatcggtgacccggatgcagggcagggggacggcgggatactcccgctcgctgacataggcgaaggccccctgttccatagcggagcggaggtactcctccttaaatttgacccccttgcagacaaagagggtgttggggatgaccagcttggagtcacaggacaccagggacaccgggtgggtcaggtcggcggtcagaggggccgcgtccgccagcagtccatggcggagcaggagctgataatagtcccccaagggcagacgggttcggttggacatacggattcaccaccagtcaatcatttttgggaaggccgaacgcgcgggccgatgtgggcatcggcccctacgggggcctgtggtgcaaaggcacaggggcggggttcgtctccgcccctactgtgtcgctcttgcggggcgtaaacgtaggggcgggtgcccacacccacccgctgctctcccctataccatgcgcagcttatagccgcaggcggtgatacacctttccgccaggatttccatggcgtccagatagtagtcgggcaggccgtggtaggtgcggtagacggacagctcggtacagcccaggatggccgcgtcgcagccggaggcgcgcagccagcggtcgatggccgcgaacttctcccgggagcccttctcgccccgcttgatctcgtcgtagatgatactcatgaccagcttctgcacgtcggccgggggcgccacggcctcaataccccgggcggcgcactccctctggtagatgccggtctgaaccgtgccgtcggtggccaggatgcccacccgctttttcccgtccgccgccagcacggccacggtctcccggggcatgtggatgagggggatggcgatatccccctggaggcggtcggcaaagtagtgggaggtgttgcaggggatggccagggcggtgcagccgccccgctccagcagtctggccccgtccagcaggcggcggtagcagccctccgcgtccccgcccaggatggcggcggtgcggtcgggcatggaggtatcgctccagatcagagtgggcagatgctcctggtcgcaggaggcgtcggtgcgatccagaatccgctggtagaagtcctgggtggcctgggggcccatgccgcctaaaatgccgaggcgctgttcagacatacccgtccctcctgtcatgcagcggcatgggacccgacgccgcgagtgcggcgtcacaagcgttttggccgacggccaaaaccttgatgccggggcaattcatttgccccgagcagatgagatcatcggggtccccgcacggcgcaagccgggtggggcggcccatgccgcccaaaatgccgaggcgctgttttgtcattttactttctccatgcacgaggcataccagcccacgtagcggtgctggccccggaggatgcgcagcttgtgcatcaggccgttgtccggccggtagaacagggggttgaccgcggcattggcccgctccaaggcgcgcatctcctggtggtaccggggattgacgtagtcgtaggccaccttgggggggatgacccaccacagatggcggttttgggtcacggtcaaggcgcagggcttgtgctcgatgacatcctccaccaggtacttggccaggttgtaccccgcgccggtgacgtagtagttgctgcggccctggcggcagttgatctcaaaggccttgaacttgccgtcccgctggtcgtacttgatgtcgaagttggagaagcccacaaagccgatggcctccaggaagccccgcagcttctcacacagctccggctccggctcggtgatgatcaccgcgtggttgccgatggcgtggccggtgtgctcctccagcaggacgtggcccacgcacatgaggcgcaccttcccgtccgcgccggagtagttggtcaccacccgcataaagctgtcgtccccggggatgaagtcctggaggatcagcgcgtcctcataccccgccccgtagatctggtcgatgaccgcgtccacctccgcccgggtctggaggatgtaggccttcttctgggtggggaaggggtgcttccagtaggtgtccgactcggcgggcttgaccacgaaggggccgtcaaagggcagctcgaacgcgtggcccatgcccttgtggtacaccaccgtggccgggtggtcgatgccgtaccggtcgcacagctcgtagaacttctccttgtggatcagcgtctccagcatgtccaggctcacatagggggcgatgacgttttccgggtagcggggcagattggcggagatggcgttgaggtagttgtccccgcagcccagcaccagaatcttcttgtcgggaaactcacgggccacctcggtgacgttctccagcaccttgtccacccggtcattgtgctcccgcacccggtagtcgatgatcctgctccccgcgcacacgctggcggggaacatgccgtagacgatggtctttacgccgtaggcctcgtgaaaggcccgggccatgctgtacgcattgatgtcggagcccagcagaacgggcacaaactcaattgccataggtaaacgccccctggaacgtaatctcataccagctcccgcccatgggccgcacgtcggcgggataggcggcggccagctcctcggcctgctccgcgctcaggcgcagctcccgccggagccgctcgcccccggcgaagcactcggagagcagccggcccaggccgctgtcctcccgcatgttctctatcttagtcatattccattctccttaaaccgggcgggcggatgatatccgcccctacggcctcgcagagtttccgcccgccagggcggaaatcaattcaaaattcgtctttccgggaatttactgcgtagccgttggcggctttgccgccctacggatacggcgtaccccttgcgggtgcttcccggaaagacaccccgacccgcgccacaaggcgcgaaaccgggggtatcgagccaagtcgccggctttgccggcacgcaggctcgtatctagggggtattggataccccctagacctagccgctggcccgtttcacctgatacacgccctggatctgccccagcttgttgatcacgttggtcagctcctcctgatttttgacctccaggacgatgctgacggtggcgtagccgtccggcatggagcgggcggacaggctggtggtcttgaccttggcggcggagagggtcatggccacgtccagggtcaggccgtcccggtccttggcggagatgtccagggcggtctggtaggaggccagctccccggtggcccagtccaccctgatccagcggcccggctcctccgcccgcttggcgtcggaggcgttggggcagtccgcccggtggaccgacacgccgaagccccgggtgataaagcccaccaccggatcgccgggcacgggggtgcagcacttggcgaacttgaccaggcagttgtcaatgccctccacaatgatgcccgactggctggtcttgcccccacggatggggacggtgggcgggttggaggtggaggggtgaatgggctcttgggcggcggccgactgctcggcgtggagccggtccaggcgggccatctcgtccttgacccgcaccaccgccttctgggcggacatgccgccgtagccgatggcggcgtacagctcgtccagggtgccgaagcgcaccttcctgaggatgaaggggagcacgtcctcggcggtgatggcggccagggagaggcccacgtgcttgagctccgactcgaaggaggcgcggccggtggcgatgttctcctcccgccgctccttcttgaaccactggcggatcttgttgcgggcctcgttggacttgcagatcttcatccagtcccggctggggccgtgggccgacttggaggtgatgacctccacgatgtcgccgtttttcagcggggtgtcgaaggtgaccatgcggccgttgaccttggccccggtcatgtggttgcccacggcggagtggatgttgtaggcgaagtcgatgggggtggccccggcgggcaggttgatcacgtccccgcggggggtgaagacgaacacctcgtcggcgaagagatccacccgcatggtgcgcacgaactcctcggcgtccacgtcctgctggctctccagcagcttgcgcacccactcgaaggcctcctcggtgcccagcttggcgttggccatgccctgcttgtacttccagtgggcggcgatgccgtactcggcggtgtggtgcatctcccaggtgcggatctgcacctcgaaggggatgccctcccggccgatgacggtggtgtggagggactggtagccgttgggcttgggggtggagatatagtccttgaaccggcccagcacggggttgaacaggtcgtggatgacgcccaggacattgtagcactcgggcatgtcgtcgacgatgacccggaaggcatagaggtcgaagatctcgtccatggtcttgttctgggtatacatcttgcggtagatggagtagatatgcttcacccggccgtagatggtgcagcggatgccctcctcgtccagccggtcctggatgcgcttctggatgcccgccagaaactcctcatgggcggaggagcgggcggccagctcgtcggcaatctccctgtagccgatgggatccaggtattgcagggaggtgtcctccagctcccacttgatgcgctgcatgcccaggcggtgggcgatgggcgcatagatctccatggtttccagggccttctccttctgcttgcgggcgctctggtactccatggtgcgcatgttgtgcagccggtcgcagattttgatgaggatcacccggatgtccttggccatggccatgagcatcttgcgcaggttctccatctgctcctcttccttggaggtgtactgcacccgggtcagcttggtgaccccctccaccagatcggccaccgtggcgccgaagagcttggcgatctcctcgtgggtggccccggtgtcctcgatgcagtcgtggagcagggcggcgatgatggagtcggtatccagctccagctccgccacaatctccgccactgccagggggtgggtgatatagggggagccatccttgcgcagctgtccggcgtgggcgttgtcggcgtaggtgaacgcgcggaacaggcgctgggcgtccagcgccgggttgtattccttgattttatcctccagcgcctgatagcgctccaggatggggtccataccagccacctcacgtaaagcaatcagaatgccagcgggcggcccggccgactcacccgttggataatatatgccgcaatttccgcatgatacaggaatcgtccagattcaccttgccgtccacgctgcgcagggcgatgtgcaggtggtcggtggtgtgctccaggcggatgagcccccgctcgtcaaagacctccaggcacaccagggtgcgcatcaccgtctcccgccggccggcggagcgggcgatgctgcgggccaggcggtgggccgtggcctccagcggggcctgccccgcgtggcccttcaggtagcgccacagggtgacgaactcctcccggctgggcagcagggcctccgcctcctgccgggtgaggggctccccccggcggaacttctcgtacagggcccgctcggcctgggcccgggtgagggcggggcgcagatcgcagagctggagctggacgctccgccacccccggtactcgttgatctggggcgtgaaagccacgtccacccggtcgcccggccccacccctgcctcctcggcggtggccgagaagaaaatggcgtcgaacgaccggccggacgcggtcagcttcagcttcaggtgccgcccgccgcccacctcgttcacggcggaaaccaggcagccagacagggagaacaccggctttgggttgcccgcgccgtagggctccagcagctccaggccctccactccctccagggtgagcaggcccacatcgtccagctccccgtcgatgtccagggcggaaaccatctcctccccgccggtacaggcgcagacatagtcgttcatggcggcggcaaaggccgggatattctcctcccggatggtgaagcccgccgccagggcatggccgccgaagccctccagcaggggggcgcagcgctccagggcggcgaacaggttgaagcccgcgaaggagcggcaggagcccttgcccttgccgtcctgcaggcagatcataaacgccgggcaggagtacttctccgccagacgggaggccacgatgcccaccaccccctggtgccattgctccccggccagcaccagggcgtgcctctgcggccgggcctcggccatggcctggcactcggtatagatctccgcctcaatggcctgccgctcccggttgaggtcgcacagggcccgggagagttcctccccccgggccggatcgtccgtgagaagcagttccccagccagggaggcgcaccccatccgcccggaggcattgatgcggggggccagggtgtagccgatggccgtggcggtaaggggccgctcatccagccccgcctcgtggagcagggcccgcagcccaggccgcccggtgcggcgcagggcctccagccccaggcgcacaatggtgcggttctctcccgtcaggctcatgacatcggccaccgtgccgatggccgccagatcggcgtagcgctccagcagctcgtcccgccgggccgggccgcccagggccaacaccagcttgagggccacccccaccccggccaggcacttgaagggataggggcagccggcccggcgggggtccaccaccgccgcggcggcgggcagggcggccttgcactcgtggtggtcggtgatcaccagctccacccccagggaggcggcgcaggccgcctcctccacggcggtgatgccgcagtccaccgtgacgatgaggcccaccccctggccccggagggcggccaccgcctcccggttgaggccgtagccctcctccatccggtcggggatataggggatcaccgtccccccctcccggcggaggaagtcggtgagcaggcaggtggaggtgatgccgtccacgtcgtagtcgccgtagaccgcgatgtgttcccccgccgccagcgcccggcgcacccgcgccgcggcccggtccatgtccttcatgagaaacgggtccaggagctggccccggccggcgtccagaaaggcgctggccttctccggggtgtccagcccgcgggcgcagagggtcagcgccgccaggggcggcacccccgccgcctccatggcggcccgcgcctgaggggcactggccgcccggttccactgcttgtatttcacggccgtatgcccccttccctcaaaattaccctttattatatcaaactctcagccttgtgacaaggcaagacgccgttcagcggcgattttttgccgccacccggcgcgcatggagcggacgcggccgcccctcagcccagctccagatagagcgccaccaggtcgatcgtcgccttcatcccctcaaagtgcgtccgccgccccacgggcctgcggcccgcggggaccccgtattcttttcttttatcgcccggcggaagtgaattccgccgggctccgcgccacccggcgcgcatggagcggacgcggccgcccctcagcccagctccagatagagcgccaccaggtcgatcgtcgccttcatcccctcaaagtgcgtccgccgccccacgggcctgcggcccgcggggaccccgtattcttttcttttatcgcccggcggaagtgaattccgccgggctccgcgccacccggcgcgcatggagcggacgcggccgcccctcagcccagctccagatagagcgccaccaggtcgatcgtcgccttcatcccctcaaagtgcgtccgctccatgccgtgggaggcgtggacgccggggccgatgagggcgccccgggcgtccatgcccgcgtgccaggccacggtgatgtcagaggagtagtgggggtagatgtccaccgcgtaggggatggcgttggcccgggccagctccaccaggcgggtgaccatgccatagtcgtaggggccgccgttgtccttggcgcagatggacacctggcgctcggtgcagctcaagtcgtcccccacgcagcccatgtccaccgccagcagctcgtccacctggggcagggtggcccctccgtggcccacctcctcatggacggtgaagcacacctcggtatcgtaccggggccgctgcccggcgatgtgcatcagcctcagcagggtgagcagacaggctgcgctccccttgtcgtcgataaaccgggacttgaggaagccgctgtcggtgaccacggtcttggggtcgatgcacacgaagtcaccgggggcgatgcccagggcctccacgccggcccggtcctccaccacctcgtcgatgcgcacggccaggttcttctcgtcccgcgggcgggtgagcacgtcgtcaaagacgtgggccgccggggacagagacaggatggttccggtgtatatccggccgtccctggtgtggatgcggcagtactccccgtccagggtgggcaggatgggcccgccgattctggtggtcatcagcatgccgtcggcggtgatggagcgcaccatgaggcccagggtgtcgatgtgggcgcacaggccgacgcgcttccccttttcccggccgggcaccgacaccaccaggtttcccttgttggtgcggcggacggcgtagccgtggtcccgggcgatttgctccgcctcccgcaccacctggtccgtaaagccgctggggctgtcaatggacaaaagccgctgggcaatgttcatgagctgcccccggcatccctttgtatccagcatttgcatcgtctcctcgtttgtagtatgatataggatcataccataaccgacaggagcggacaaccatggccgaagaaaagaccaatgtgatgcgtattttagaccaaaaaagggtgccttacactccacaccactacgcccaccccaacggcgcggtggacggggccagcgtggccgccctccttgaccgggaccccgcctcggtgtgcaagaccctggtgacccagggggccagccgccagcactacgtctttatcatccctgtactccgctcgctggatctgaaagcggccgcccgggctgtgggagagaagtccatcgagatgatccctcaggccaggctgctccctctcaccggctacgtccacgggggctgctccccggtggggatgaaaaagccttttcccaccgtgctggacgggagcgtggaaggactggacgccatcgtggtcagcgccgggaaaatcggagcccaggtggagctggctccggcagccctctgcgccctggtgggtggaaccttcgcgccggtatccaaataatttttcctccagcgggaactttttctccgccttctcgtctaaggagcgtgcaaacccaaactgcaaaggagaatccaaatgaagaaactcggtacgcttgcccttaccctcaccctcaccggggccatggccctgcccgccctggccgcggaggagccggaactggtgatcgcccccgccgacaccggctacggccagaccatcgtgctcaatggagaaaccctggatctcaccggcatccccggcgtctccggggaggagctgctccccctgcgcctgctggccgaggccgaccacggctccgcctactgggatgaggagaacaacgagagctggttcaccttcggggacaaccgcatcaccgtcaagttcgctgacaacagtgtttggctggacgaccaacaggtgaaatccaccgcccaggtggcggacggcatcacctttgtagaggcgggcgttctgtccatgctggagggctacacggtagaccggaaccccgaactggatgtcaaccgcatcgacatcaccacccccaacaacgaccccatggtgaagaccgcctatcagatccgcgaggagagcggcatggccttcggcatgcggagcgacaacgcagaggtggcgaccctcttccagctacccgaggacacctttgagcaggccatctgcttcacctccatgaacaccacccctgatatcatggtgctggccaagctggccgacggcgccgatgagaccgccgtgaaggaggccctggaggcccaccgccagtcccagcacgacaccttctcctggtacctggcccagaacctgcccaaggtggaggacgcccgcattctggtggaggacggctatgtgttctacctcatcgccgagaacgccgacgccggcgaggccgccttccacgcctatgtggaggcccaggcctaacctgtccgtccataacaagtgccccgccggctggcggggcacttgttttttggccggccgggccgtataatgttgcccaaaggaggaatcgtttatggaatctgccgctccccagactccggttcaggccctggaagcccttcagaacgcctacagccggttcctggacgcgcttccggaggcccgcagggccagcttgggggaggccatcggcttcttcctccgctcggacggcaatcccaagctgggcagtctggtggacgccttcgctgaagagctgcccgtccatgtggaggcactgaaaacccggctggcggcctgcccggcggaggaggccgaccgcctggccacccaggccctggagctgatgctcctctatccccggcccaaagacggagccaccgagttctccctggccgcctttgagggctttgccgccccgctgctccccttcctggcccccgcccgccgggcggagctggcggagcgctaccgggcgctcaccccgccccggaagatgctgcctaaccagaaaaagctttggaaggccctgtccgggcgctgaagcccaagcacagccgccccccgcgcctctggcgcggggggcggcttatatgtctgttatgtccggagccgctccatgaactcctcgccggtgatcgtctccttctccaggaggtagccggccagctcccggagcttggactcgttctcccgcagcagtccgagagccttctggtgggccgcgcgtaccagctccaccacctggcggtcgactgcggcggccgtctcagccgagcaggacagggcggcgtcgccccccaggtactggttctgcaccgtctccagcgccaccatgtcgaactcctccgtcatgccgtagcgggtgatcatggcccgggccagcttggtggcctgctcgatgtcgttggaggcgccggtggtcatgttgtccgggccgaagatcagttcctcggcggcccggccgccggtgagggtggccagcttgttctccagctcggtgcggctcatgagcatcttctccccctcgtccacctgcatggtgtaccccagggcgccggaggtgcgggggatgatggtgatcttggtaacgggggcggagtgggactggagggcggccaccagggcatggcccacctcgtggtaggagacaatctgcttctcctggggggagatgaccgcgttcttccgctgggccccggcgatgacggtctccacgctctcctccaaatcggcctgggtgacggtcttccgccccaggcggacggcccgcagggcgccctcgttgacgatgttggccagctccgcgccggaggcaccggcggtggcccgggcgatggcgctccagtccacgtccccgtcaatatgaacccgcttcccgtgcaccttcagaatggcgatgcgcccctggagatcgggcagttccaccggcacccgccggtcaaaccggcccgggcgcagcagggcagggtccagggactccggccggttggtggcggccagaaggacgacgcccttgctggagtcaaagccgtccatctcggccagcaattggttgagggtctgctcccgctcgtcgttgccgcccaggccgccggtgtcccgcttcttgccgatggcgtcgatctcgtcgatgaacacgatgcagggggccttctcccccgcctgcttgaacagatcccgcaccttggccgcccccatgcccacgaacatctccacaaattccgagccggagatggagaagaagggcaccttggcctccccggccaccgccttggccagcagggtcttgccggtgcccggcggccccaccagcagcacgcccttgggcaggcgggcgccgatggcggcgtacttctccggcccgtggaggaagtccaccacctccatcaacgactccttggcctcgtcctggccggccacgtcggcaaaggatacgccggtggacgcctcctccacgtagaccttggcccccgacttgccgaaggtcatggcgttgcccatcccgccgggcaggccgcccatgcgcttcatcatccagcgggagagcagctccccaatgacgataaagatcacaatgggaagaatccagctcaccaggaaggagagaatggggttggcctgggtggggatctccgcagtaaaggtgatcccctcctccgcctggagctgggccagcagccgctggccgtcatccggccagacgccggtcttgtaatagccctcccggccgccgtcgtccttcgcaatgaatacgatctcccggctcgtctcatccagagccacctgctccacctggccgccgtccaccatggtcaaaaactggctgtacggcacctccaccacctggcgctccagcagggacgggaagagaaacacgttcagcagcatcagcacaatcagcgccgccagatagtagaagatcagcggctttttggggggcgaagtctttatctcactgtccttcagttctttcaaatcaaaattcctccccggtttgaaacattattttgggtacgaaggaatcataggcgctctccctccaaaagtcaacgcgcccacggcgctatttacatattgtttacaaaagaggctccatccagccggacggagcctcttttgttcaatatttgttcaccataccggcaatcagcggggtgggcaccagccacatcaacaggaacaccagcaggttggcggcggacagggaggcgtaggagcatacaaaggtgaggtagaaggccagcagcagccccgccacagcacccaggcaggccagcactgcggcggtgcgcaccgcccggcgcagccgggccgcccccaccacggcctcggagtagggggccaccccctcacggcagaggacggcggtgaggatgtcgctgtggggctgctcctcgtcggacagctcccgccgccgttccaccgccgggaactccatcttgtccaccggcagcttgaagcgctggcgcagcatggcggggatcaggttgaagtcgcgggtggccatcaccggcgtgacccggttgcggatgaggctgttcagcgacggctccagcgccccgtggagcgtgtagttgagggcgaatatgcccgccagctccccgtcgatggcgcagaacaccgcgtttttcacgttgagcccctggggcagggtgatctccatcaggtgcatgaaggacgccgagcccaccagcacctgctggtcgcggatgacggcggacaggccgccctcatacacgcagaagtcggaggcgcggcggtacacgcacccctgggcgcggagcaggtcgtggaagagcttgtccagcccgcagcccgcgtcccggataagggtggcggtgtcggacaccaccttgtccaccggaaagtccccaaagatcttgatgccgttgagggacacgcagcccggcgggaaaaagtcggtatcgttgagcaggatgccgctgccgccggtggcagtgaccccgtcccacccggcgatggcggcccccgacttgctcagccgctgggtaaggctcagccacggcagggcgaagcacagcgccccggacagggaggcgcaggcggtgagcatggcggacaggcaccagagcagccgttccggcgcgccccggccgatggaggccaccacactgagcagaaggcacgcgatgaacagcagcgggcagacccggtggaagatccgctccgccccgtcggcggcctgcatctggcgaccgaagccgatgggctcccccgaccacttggcgtaggtgtcccagccattccacttgccctcgtccagggtgaccagatagggttgggcggcggaggccgccgtgcggcaggccatgcgcagaccacgccgcttgcgccgggcgccccgcaggagaaagaatatccccagcacaatggccgcgcagtagggcatctgaccgtcccgggggtccaggcggtacatggtcagcgcgtcggccagggtggccgcggcggcaaagaccagcagcgtgtccatgcccagctccagccgcagcagacggaacagcccccgcatgagcacgtccagccccagcagcatggccgccccctggatacccgccagggcaagcacccgcagctccggggtgagcacagccgggtaggggaacagccccagggtcaggtagagggcgggcagaagcagcaggaacaccagcaccgagcgtacccccatggacttgaggcccttgccgtaccgccgggccagctccgccgcgggcagatccggggcggggggcggctggcggcgggggcggcgctcccggaagacctcctccggctcctcctcgtcggtgccggggatgtactcctccgcccggcgcacctcctcgtcgtcctccttgccctcctcctcaaacatgtgtccggcgtagtcgtccgccttctgaaacaggcggttgagaccctcggcaatggggttgtccgatgccggcccctcctcaccggggaactccaacaccttgtccccgtcctccggcggctcctccggctccggctgaggcggcggaacggggggcgggtcctcccgccggcccgacgggaaagacaccaccttgcccggcccgggcggcccggcgggagacggcgccgtgcgctgggaacggggcgtcaccggaaaggggatggtgtcctccttccaccgcggcttggccgcgccgccgccgaactccgccagaatctcctccagggagaacgtctcctcgccgggcatacctgtattccgttcgtcgtcccggtccttggacatggttctcacctgctttgcataatttggatacgcgggcggccataaaggccgccgcctttccgtcccgcttattgcattctctgccgcacggcctcatagagcaggatggccgccgccgcggaggcgttgagagagttgagcttcccccgcatgggtatgcgcaccttgaagtcgcaggtctcggccacaaggcggcccatgccgtccccctcgctgccgatgacgatggcggccgggcccttcaaatccgcgtcgtacaggagccggtccccgtcggcggcggtgccgaacacccacacgcccgcctccttgagctccttgagcagggcgggcaggttggccacccgggccacgggcacgtggctcaccgccccggcggaggtcttggccaccacggcggtcaggccggcggagcggcgtttgggaatgatgacgccgtgagcccccgcgcactcggcggtgcggatcaccgcccccaggttgtgggggtcgctcagctcgtcgcacaccacgatcagggggggctcccccttggcccgggcggcctccaggatgtcgtccacgctggcgtactcccgcaccgccgccagggcgatcaccccctggtgggagtgggtgcggctcatgccgtccagcttgcgccggtcgcactccaccaccacaacgcccttggagcgggcggtggaggcgatgtgtcccagggccgcgtcggtctccccccgggccagatagatcttgtcgataggggtgcccgcccgcagggcctcggtcacggcgttgcggccctcgatgatgccgtcggcctccccgctgggggccggtctgcgctccttcatggtctgtcctgcctttctcattggtccgatactggacaacagtataccacaagacggcggatcaaaaaagccaaaattgccgcattcctgcaaaaagagcggtgggcctccccccttgtttttcatagaaagtttacaggtttcgccgcgccgttccttgttttttcaaactccttgtgctataactataattactttgaatattgaatgtttcccatcaaggaggaacgagacttgaactccaatcagaacaacaaccggggcaagggcggcggcaacaagcgcaatatgacggccatcgtctctatcctgctgtgggccctggttctcaccctgctggtcaacctggccacgtccaggctacagcaggccaattccgtggaggtgtcctacggccagttccgccagctaatcatgcaggatgccgtggagtccgtggttatgtcaagcggcaagtacaccttcacgctgaaggagggctactctctctctgtcggcgaggacggagaggtgaccgtccgcacgccggaggagggcgggcaggacagtcaggccgctcagacgccccaggagagcgggaccaccggcggagtgctggacctgcccctgttggacgggacagccccccagcagcagccggtccagagccagaatcaggcccagagcgccggcggcagggaatccctggtctacttctgcgcccccatcacccaggcaagcatccgggacgatgatcttgtctctctgctggaggagcacggcgtcaccaacttcggccccgaatatgtggagcccatcaaccccattctgtcggtgctgctgtcctgggtgctgcccatggtgctcattatggtggtcttctccctgctgatgcgtgggatggccggcaagatgggcggcggcatcggcaacctgggcaaatccaacgccaaggtctacgtggagcgcaagaccggcgtcaccttcaaggatgtggccggccaggatgaggccaaggagtccctggtggagatcatcgacttcctccacaacccccagaagtatacggaaatcggcgccaagctgcctaagggcgcgctgctggtgggcccgccgggcaccggcaagaccctgctggccaaggccgtggccggagaggccaacgtgcccttcttctccatctccggctccgacttcgtggagatgttcgtgggtatgggcgccgcccgcgtccgcgacctgttcaaggaggccaacaagatggccccctgcatcgtgttcatcgacgagatcgacaccatcggcaagtcccgcgacaaccgcatgggcggcaacgacgagcgggagcagaccctcaaccagcttctggccgagatggacggctttgaccctaccaagggcgtcatcctgctggccgccaccaaccggcccgaggtgctggaccaggccctgctccgccccggccgcttcgaccggcgcatcatcgtggaccggcccaacctggccggccgtctggccaccctccaggtgcacacccgcaatatccgtctggccgaggacgtgaacctccgcaagatcgccatcgccaccgcgggcaccgtgggcgccgacctggccaacctggtcaacgaggccgccctgcgggctgtccgcctgggccgcaaggcggtcaaccaggaggatctgctggccgccttcgagctggtcatcgccggcgcggagaagaagggcagcgtcctcagcgagtttgagaagaagctggtggcctaccacgaggtgggccacgccatggtggcctacaggcagaagcacgccgagccggtgagcaagatcaccatcgtcccccatacccagggcgcccttggctatacgctccacctgccggaggaggacaagcacctgcacaccagagatgagctgctggcccagatcaccgtctccatgggcggccgcgtggcggaggagctggtactgcacaccatgaccaacggcgcggcccaggatatccaggacgccaccggcatcgcccgcaacatggtggccatgttcggcatgagcgacgagttcggcatgatggccctggcctcccgccgcagccagtacctggacggcggctacggcatcgactgcgcccaggacaccgccgccgccatggaccgggcggtgcgggatctcatcgacgcctgctacaagaaggcagtggagatcctctcccacagccgggaggacatggacaaggtggtggagtacctgctggagaaggagaccatcaccggcgcggagatggtggctattctggagggccgcgaccctgccctggcggacaacttccccgacccggacgggaaaggaacggtcgggcccccggcagagcccgtctccgaccccatccccctgagcggcggcgagccccagccccccaacggcggcggcatggagttcggccccgagggcaagcccaaggaataagcaaaaaggaacccccgcgagtccgcgggggttcctttttgtgcccggtcatgggaacgccgcccactccaggccggaggggccatctgaaaaggccgccccctccacttggcgggtacaggtccggcccagactgtccaccgcctccaccagcaggagcacctcgtcccctgcctccactcgggtttgacgctggaaatctgatacatcggcctccaggcggccgtgctccaccggaagggactgttcccactccggcgcgccgttccggtactggcgaaggacggcgcgctctactgtcactaaggagccctcggggggcacacaggccgcccaaatactcccgtcccaggtccatatcccgccggacagggttccgcccttccccttccgcgccgtcagctccagcggggccagggcttcggcggtcacggtccactctcccagctcctgccggtactccgcgccggagggagtgcgcgtccgcagcgtgaaatggtactcctcacccagaggaaggcgcagctccgcctcataggccaggccgtcccggtcggcccgggcggtgaatcgctctccgcccccctccgccgtcaccgacaggcccaaccccggcgcctccacctcggggacggcccggagccgccagcaaaaggtgccgtcctcccccagggcggcgactccccgctcctccacctgccacatccggccgtccgccagggcggcggccaaaagccggtcggcctggccgctttgaagggtgttcacccttaggaccagcacgacgcataccgcgcccagcgccgccgacagcaggggccacagccgccttttccacctgggtacgggccggggcggttcggcggccgccgcctcctctacccccagcagcacccctaccgggaggtgaaacaggcggctcagggccaccagcttgtccacctccggcaccgcgccgtcggcctcccatttggagatggcctgccgggtgacgcccagcgcctcccccaggccctcctgggacaggcccagccgcttccgctccgcctgaatacgctgcccaagggtcacaggccccccctcccctctctgcctcccagtatagccgaacaggagcccctttggcaaccaagccgccgtttccttttgtcaaccgccggttgcccctccgctctccgggtcaaagaaggccgccagccggtcttgcccgccgaacaggttgttgtactggaggcgctggtagtcctcaatccgggcggtgaaatcgttggtctccagatggctgtaggcccggcccgccgcgtccgtatagcccacgaaggtgagggcgggcagctcctcctggagctgccacaggaagtccccgtagggggtgcccgcaatgcccgcgtaccgcaggaggtactggcccaggaagttgaggctggtcgtctccggccccgtcccgggcaggggatagttggcccagatgacaaagggcacatagtatttgcccatatactgctccatagtcatctgctcctgggtgacgccgtaggccagatcgaggaagccctgctccaccgagggctggtgatccccgaacataatcacgatggtgggctcgtcaaagacccggagatactccaccagggcgcggaaggccgcgtcggtcttgcccgccagggtgaggtactgctccgccatggggtactcccccggcgcgtcggctacggtgacctgcgccgggtagtccggcacggtatagccgccgtggttctggatggtgacgttgaacaggaacagaggcttcccctcctccttgtgctcaagctcccagataatctgttcaaagtcggactggtcgctgacgtagccgtgctcgaaggtctggggcacatccatgtcgtcgccgcacttgtaggagtcgaagcccagccgggggtaggcccgatctcgctgccacgaggcccgctccccagggtggaaggccagggtggaatagccctccgccttcagaatggaggccagggaggcggtgggccccagcacatactgctggtaggggatgctgcccgagggcaggaaggccatggagttgccggtgaggaactcgaactcgctggcgctggtgcccgcgccgaacaccgaggtgtaggcgtggccatacaccgcgttgtccagggagcggatgtagttggtgacgctggcgctgagggtcaggtttccgtagtcctcaaagtcggcccaggactcgttcatgatggccacaatattgggccgctccacggaaaccgccgccggctccggcggctccacgccggccatgatctgttccagccgctccggcgtgacgtcctccggctcctccacctcgaggaactccgtgttgcggaggaataccgccaggcagccgccagcacggtaggagccggcggggtcccacacatcggtcttaacaccgaaacgctccagccgcccggtggggaacaggagcaggaggcaggccagccccgcccccaggcacaccagccgcaggggccgccgcgttccggtgaggcgcaggcgggccttgtgtttctccggatggaggaacacaaccagggccgccgccagggcgacggccgccagcatctgccacgtgggcgtaaagcggtagctccccgccacatcggcggcggtgcccagggcggagagatcccagggcaggatgggggtgccccggaaggactggacaaagcagttggccgcgccccacgcaccggaggcgatgtggatgccgatgcagcagggggcgatgcgcccggtcagaccacacaggggccagtacagcagggcgatgcacagggcgttggccagcagcgccggaaagagcatggcccagggcaggacgccgtaggtgaactgcatgagccaggcggcggtgaacggggtcagcagcaggaagcccgcctgccacaaggtgtcggttggaatcgaaatgcttcgtttcatggggtattctcctgaatctaagggtatagtctgtgattataccgcagaatttcccctctgtcaaaaaaggacggacggcgccgaaccggcgcacgtccgtccttttgctgctttacgtctcctccggcgcccctgtgcggccgccgaaggcctcgatggctcgctcgtcggcctcccgcttctcttcaatggcctctttcagtaacatgtccttgaccttcatgaggcggatggtgttggcgcgctcgttctcgtccagcttcatggtaatatactggatggcctcctccatttgggggatctttacatactccagggcgttgacccggcggcgggtcttctcgatctcctcggccaggagctgggaggtcttttcgatctccgccaggcggagcatatcctggagcacgccggacagggcctccacggcgccgtccagttcgccggaggtggtggcgaagccgtaggggtagatttccccggcgtcgtcgctcttggtcttgaagtggtacaccggcacattgacgctcatgatgttctggaaggtcatgtccagctccacgctctgcttggggtagagcagggcctgctccagcatctcggtggacatgagggcggaggccacggtgaaggagccgtgggcgcgcatcagcccctcctccaccctcttccgcagggcccggttctcccgcaccacgtccatgaactgcttcatgagctcgtcgcgcttgtccttgagcagcttgtggccccggatggaggttctcagccgggttttcagccgcgtcagctcctgccgggtggggtttacgttaatcgcaggcatggcttacccctcctctccttgcgccaccatcagacttcagaggggccccgccgcgcggggacggcgcctttgcgccgcaaaatcgccgcaggcgatttccgcagggcggattcattccgcccgaggatgggaaatcccggggcccccatgcggccggccgtatggggttcacgttaatcgcgggcatggattacccctcctttttcgggaggtatttctcaatgaactccggcttgatgcgcttgagctccgccttgggcaggatgctcagcagctcccagcccagatccagagtctcctcgatggagcggttctcgtcgctgccctgggccacgtagcgcttttcgaactcgtcagcgaacttggcgtactggaggtcggtgggggacagggcggcctcgcccaggatgctcatgagctccttgttctccttgccggtggaataggcggcaaagagctggttcatggtgcccgcgtggtcctcccgcgtcttgccggggcccacgcccttgtccttcaggcgggacagggagggcagcacgtccaccggcgggataatgcccttgcggtagagctcccgggagaggatgatctgtccctcggtgatatagccggtcagatcggggatggggtgggtcttgtcgtcctcgggcatggtaaggatggggatgagggtgatggagccgctcttgcccagctgccgccccgcccgctcatagagggtggccaggttggtgtagaggtagccggggtagccccggcgtccgggcacctccttcttggcggcggacacctcgcgcagggcctcggcgtagttggtgatgtcggtcatgatgaccagcacgtgcatgcccttctcgaaggccaggtactcggcggcggtgagggccatgcggggggtggcgatgcgctccaccgccggatcgttggccaggttggtgaagagcaccgtccggtcgatggcgccggtgcggcggaactcctgtacgaagaagtcggactcctcgaaggtgatgccgatggcggcaaagaccacggcgaagttgcccgcgtcgtcccccagcacacgggcctgccgggcgatctgggcggccagggccgcgtggggcaggccggagccggagaagatgggcagcttctggccgcgcaccagggtattcaggccgtcgatggtggagatgcccgtctggatgaactcgttggggtagtcccgggcggcggggttcatgggcaggccgttgatgtcccggtactcctcggccaggatctccgggccgccgtcgatgggcttgcccatgccgttgaacacccggcccagcatgtcgccggacacgcccagctggagggggtggcccaggaagcgcaccttggactcggccaggttgatgcccgcggaggactcaaagagctgaaccacggcgttgtcgccgttgacctccagcacctggcagcggcgcacggtgccgtcgggcagctcaatctcccccagctcgtcgtaggtgacgccggacacccggcgcaccaccatcagggggccgttgacctcctgtatggtacggtattccttgatcattcctcagcacctccccgggcggcgatgtccgcgatctgctcctccatctcccgggccatgtcggcgtagacggcggcgtaccggtcgtccggcacgctcttggcccggcccatctgctcccggaaggggatggcgaacagctcggcggtggcggcacccttctcaatggcggcgcggcacagcttgtcgtaatccagaatcatctggatcatcttgtcctggcgctcgtagctggagtaccagtccacctccataaagccgttctgctggaggaaatcctcccgcagcatcttggcggtctccagggtgagctggtcggcggcggacagggagtccttgcccactagctgcacaatctcgttgaggctggcctcctcctgaaggatggacatggccttgtcgcggttcaccatgaactggggccccaggtgctcgtcataccagggcttgagggagtccaggtacagggagtaggagttgagccagttgatggccgggaagtggcgcttgtaggccagggaggcgtccagggcccagaacaccttgacgatgcgcatggtggcctggctgaccggctcggacaggtcgccgccggggggcgacaccgcacccaccgcggtcagggagccccggcggtgcccgtcggagccgatgcactccaccatgcccgcccgctcatagaactgggccaggcgggaggacaggtaggccggatagccctcctcgccgggcatctcctccaggcggccggacatctcgcgcagggcctcggcccagcgggaggtggagtcggcgatgacggccacgtcgtaccccatgtcacggaagtactcggcgatggtgatgccggtatagatggaggcctcacgggcggccaccggcatgtcggaggtgttggcgatcagaaccgtccgcttcatcagggactcgccggtgcgggggtccaccagctcggggaactcccgcagcacgtcggtcatctcgttgccccgttcgccgcagccgatgtagaccacgatgtccacgtccgaccacttggccagctggtgctgcatcaccgtcttgcccgagccgaagggcccggggatggcggcggtgccgcccttggccacggggaacagggcgtccacgatgcgctggccggagagcagcggggttctggggggatacttgtgcttgtagggccgccctacgcggacgggccacttctgcaccatggtcagcgcgtgcttctcccccttcccgtccaccagcaccgccaccgtgtccagcaccgtgaaggaaccggactggatggactcgatggtgccggacagggtggggggcaccatgatcttgtggagcaccacactggtctcctggacggtgcccagcacgtcgcctccggtgaccttgtcgccgggcctggccacggcggtgaagtcccacttcttctcccgatccagggcgggcacctccacgccccggggcaggttgttgttccccgccttccgcatgatgccctccagggggcgctggatgccgtcgtagatgttctcaatgatgccggggcccagctccacgctcatgggcgcgccggtggtctccaccaccgcgccggggcccaggccggaggtctcctcgtacacctggatggacgccgcatcgccgttcatgttcagaatctcgccgatcaggcgctgctcgcccacccgcaccacgtcggccatgttggcgtccttcagccccgtcgccaccaccagcgggccggagaccttgacaatttttccgctcaatgcttcaaccttctttctcgtcggcgcaaactgcacatccttcgcgtccccgtaaacgggaacgctcactcgttccgttgcgcctcctcctccccgccggacccacttcgttgggctccgccgggggtgcgggcggccagaaaggccgcctttatctgcctcgcagagttcgcgccaaaggcgcgaatgaatctcaagtctgttttccccggcgacatgtgcgtcggggaaaactcctcacagcctgcaagtgtgagttttgcccgcccaaggcgggtaaaacttgcgcgcggcaggctgcggccttctcaaaaaagcggctgtgccgcttttttgaatgtcaggggggtatcggcggcggtttccttgggaaccgccgccgtatctaggggggaagaattcccccctagaggatatccgcgcccacggcccgctccacggcccgcttgacgttggccataccgatgcccagggagccgtccttgccggggatcaggatgatcgcgggggtcagcgcgtccttgtaccgctccaactccgcctccatgtgggccgcgtacccctcggtcaggtacaccaccgcgtagttctccttcgccagagcgtgaagggtgcgctttgcctcctccgcgctctccgccgggaacacgtccagccccagggccttgaagcccagcacgctgtccttgtcgcccagcaccgcgattttatagttagacataggcctcacgcagcctttcccgaatagtgtccgcgtccagcccggccatacggccggagaggatggtgcggatggcggtgaactccgcctcccgggcgtacagatagcctaccaccgcctgctccccaaaggggatgcggcgggcctgggccaggtagcccatcaccgcgtcgtcgcacagccgctcaaaggcggtgagctccccgctgccgggagcggtgagggccgcgccggccgccgccgcatcactgaggggaccggcccggaacaccgccgccagatcattgcccttgcctgacgtgagcacgtgggcctccacatttcccccgggcaggagtacctggctcaaaaagtcgctccccttccccatccgggcgcaccggacggcggagcgcaggttggcggcgtcgatgagcagccgcacatacccctccaggaaggggctgcccaccgcgcgggccgtctccgccatctccgcaaaataggcccggtccagcacaaagtcggccagttgagggtcatttccaccattgagggtctcccgggcctgcacaaccgcccggcggaaggggccggtgaactcccgcaggctgtcccgctgaaaggcctccttcacctgggcggcgctccaccgcccgccctccatcagcagccggtcggcgtccgcccccaccgcggccccctttaccagggccttggcgttgtggtagtcgtacttcatctgaaacagctccaccagccgtttgtcgggtactgcgccgcccagctcccggtacagggccgcccgcgccgccgagagcagctcgtccagcccacggttggtcagggccggcagctcctcatagccgcactcggccagcaccttcaccgcctcgtcgtcgctgcgggcctccaccatccgctccatccgctcccgggtcaccaggcggttctccatcgcccgcacgcgggccgagatggtcaaataatccgtgtctctgatcttactcaagttttcgcctccctatcggagcgctcagccaaagagcacctccacaaccgtccggtccatctcgccccgcaggaggcgcaccagtgtttcaaaggtgcagttcacttccacgtccccgtcgctgagaatcagcccgccccggatgggccgggtctggacagacagggtcaaatggccgtctcccagcctctcgttggcctgggtgaccacctgcttgccatagcgcgcccggtccttctgggacagaatgacctcctcccgtcccgtggacgacgcctccgccgccagccccgccagcagccctacgtattccccgtccggcaggcttgtcagccgctccatggccctgtcgtaggccttggccagcatctcctgcttggcggccagctccagcttgcgggcgtccaactgggccacgctggcaagccgcgcctggcgctcctccgcgctgcggcggccgcgggccgcgatctcctccgcctcccgcttggcctgggcctcgtagcgggcggtgatctcgtcggcctgccgccgggcctcggcctggatggaggcgatctccgcctcggtgtcggccgcaatgcgcccggtgattttctcaattccgtccatagccgcctccgctcagaagccgaacatgatcatcaggaaggagatgagcagggacaggatggcgtagaactccacgatgatacacagcaccatgcccttggaccagtcgttggggttcttagccacaatgttgaccgaggcggcggccacccggccctgggcgatgccggagagcaggccgccgatggccatgggcaggcaggcggccagaatcagcaggccgttggcgatggacagctcggccacggtgccgtcgaacaggcccattttcatcagggccaaaaagccgatgaccagcccgtacaggccctgggtgccggggatgacctgcaggatcatacacttggagaactgggaggggtcctcggccagcaggccggcgcccgcctcaccggcgatgccggtgcccttggcggagcccacacaggccaggccggcggccagcgccgcgcccaggaagccaaagaacgcacccgcgtactgggtcagaaattcaccgatcgtcatgttactgttcctccttaatatcgacaaacttggtcgcaatgttcaggggccgccaggggcgtccgccctccttgtagaactgcttgaagaactccagatattgcaggcgggacgtgtgcacgtaggtgccgatcacgttcaggccgatgttgaaggcgtggcccacaataaaaatcacgaagaagatgggaatccccaccgccgggggcaggccgccgccgggcatggcgcccaggatgttgaacacctgcccgatcaccgagccggccagcatcatgaccatcaggcgggagtaggagaggatgtccccaaagtaccccgtcacgccgttgtagaccgcgccgatcaccgccgtcaccttgccgaagcccttggcgctgcggccctgggccagcagcatcaggcagcccagcaccagcaccacagggatgccggccacgctgcctacggaggaaacgccggtcaggttcagggcaaacagcccgatgcccgcaaagatcacccaccaggtgccgacgtcccacacggcatcccacacctggccgtcccggcagagcatccagaacttgaccgccatgcccaccacaatctgcacgaagcctaccgccagggcaaagaccagcacggtcatggggtcctccatcacgttgagcagaggggcgggcaggccgctgccctccggcacggagaggaaggggacggccggctggggcaggcccagcatgccggtgaactgcaccagaaagtcggagaaaaatccgccggttagcagcccgatcaccgccgacgagacgccgcacatggtcatcagccggatgagctggccgaagccgcccttgggccgcaccttatgctggatgaacaggcaggcgcccgccagaagcaggccgtagcccagatccgcaaacatgaagccgaagaagaagatatagaacggggccatcaggccgttgggatccaccccgtcgtaggcgggcagggagtacatctccgtgatggtggtcagcggctcggtgatggcgttgctcttgagcttgacgggcaccaccgggtagtcctccggcgccgggtcggacgtctcccagcagcaggtgaactcccccagcttgcgcagcagcttctcctcctcgggcacgggcacccacccgtccaggtagaaggccgtcccggagtccagcaggcggctcttggcctcctcccgggcgatctcctggaccgcccggtccaggcacagctccagcgccgcccgcctgggggcgaagccggccaccgcggcaatggcctcctccagtgtacgggcggcctccgcctgcccggcctccagccgtttgtcgttctcggccgccgttccggtccagccccgcagggccgcccgggagaagccgtactccttgagcacctcctggcaggcctcctccgcgctgcggtggcagaggaacaccaggtattgcagctgcgtgtctgccccggcccggagcacctgggtcagctcacttttctccgccagctcccgctccagcgcgtccaggtcggcggaggcggccacggtgccgaaggacaccgccacctccggggtggaggccgtctccagcgggatgtccagcgccagccagggcgccagagccagccgctgggtgcgcagcttgttctgctcggcatagagggcggtgatccgccgctccagctcccccagccgcccggcgtccgccaggccggcctcataagccgcgtcgtcaaagagctccccctctgtgaccaccggccggggcttgagcagcccgcccttctgcttggggccgtattttttcaaggttttgagcgccccctccacacgggcccgcgcgtcccgggccgcgttcagcgccccggggtccggccgcgtcagggcagcccactccgggtcgtcccccagatggggcggctcgtcaatctccacacagcccatgtgctgaagcagccgcagcaggctctcccgctcggcctgcatgccgataagccgcagccgcttcattttaacaatggacattcgttttcactacccttctcacgatgctctcagcggcgtccgccaggcgggcctccgcctgggcccgcagggcgtcgcaggatttccgggtctgggccatcacctccgacgcgtgttcggccgccttggcctcagcctgccgcatcagctccctcgcctgggcctctgcctgggcgcgggcctccgccaagcgggccttccccgcccgttccgcctcggccaccagccgtttggcctccgcctgggcctccgccctgcgggcccggttggcctcctcggcctcggtcacctgcttcattgcttccagagacatgctctcaccgcctttctctatcatccgggtcgcccgaaacaaattttcccgatgatatatgaatgatacttcaaatcggagagaatttcaagtttaaaattataagtttactttttaacataattcgttttccttctgcctcttccgctgggagccgacgaaaaaagcggacgcatagggctatgcgtccgcttttgggcattattcgcctgtcatggccagcacggcccagtcctcccgggcctgccccgcctgctccagcacgggcaccaccggggtctggttcagccggggcagggtctccccctcccccaggcgcaccaatacgcggtcggcgcgctccagcagagcggcggtctggccgctctccaccgccccgcctgcggcggcggaggcggtggtcaccagggacacctttacctccgggaactccgccagtccggcgcgcacctcctcgagaaagacctccagcgcggcggtccggccgtcagcgggatagttggcatcggccttaatccagcccagttccccgtcggtggggaaggcccagttgtccagcaggatctcatcaaagcccagggccgccaactcccggcacacgcccaccacatattggcgggcgctctcattggccgggctgagccagcgggtatcgccgctgtcccgccagttgcccgcgttggtgtggatggccagagacatgtcgctgcggggcacaaggttgtcccggaagcaggacacccgggccacggtatacacctctccgccgttgaggagctggatggccgcgttgagggccgggtcggcggcggatgcctccgcctggatggccagggccagcccggagatatagcccaggctgccgtcgtccgccttcatgtcaaagagagcggcggtggcgccggccgcctccacctgctgggcggcggtgccgtcatagagggcggaattgggcagcagaatcccccggaagtcctcctccggttccggtgtgggtgtgggctccggcgtggtcaccaccaccggggcgcccgtagcaggcgccggctccttctgctggaaaaagggcagattgattttaatgccgttggcagagtagtcgatgtatggctcgagccacagcagagcacccaccgccaccgccagcacgaccagcagcaggacaatcagcactttcaaaaaggtgcggacgcggctgcgtccgtggtaggaatcgtatccgttgcgcctcaccggcgtcccccctcttcgcggcattcacccggccacgcctgaatagcttggccgttttttgcccgttctatcacggtccggactgctctgtcccagcctgaagcagcgcgtcgtccagcttctggaaagcggcggcgatcatggcccggtcctcctggctcatgccgctgagcagggagctgaaatatccgctcacgtcagtggccgccttggcccgcagggcgttgtacttctccgtagcgcagacatagatcacccgccggtccgtctcgctgcgctgccgtctggccagccccagcttttccagccggtccacaatgcccgacaccgtgctgttggcgcttccggtgcgctcggccagggcgctgatgggtaccggcccatcctcccccagcaccgtgagcaccagggcctggggaaaggtcaggtccagccggccgaagtggctgcggaactgctgggacatgtgctgtgtcacccgcagataggacatgaaaatattgggctgttccatcggtcaatgctccctcctgttacgcgcatccacagaaccgcctcagcccatggcctgggtggtaaggcgctggagaatcacggccagttgggcgcgggtagccacgccgccgggcagcagcctgccgccgtccccctccagccagcccatgcccaccgcgtggcgcatgctctccaccgcccagacgccggtcatgttggcgtcggagtacaggttgagggagccctcggccagcggtacgccccggtattggtcaaagcgggtgaggaaggccgccagctcctggcgtgtgacggattgatccggcttgaagtccccccggctgtcgccgttggcaattccgttctccttggcccaggccaccggctgggcataccacgcctcgggggacacgtccccaaaggagacggtggccgtgggggccggcgaaccctccatccgccacagcacggtcactaccgtggcccgggttacgttggcggtaggggcaaactggctctcgctcacgccggtcatatagcccttttcggtcacctcattgactgccgactcataccacgccccgccgggcacatctgtatacccgcccgcggctgccgcgggcagggtcaggctggcacacagacacagggtacaggccagcgccgtccatcgctttttcaaggcattcactcccaatcttgttaggctgtccccattctacgacatggattttacaaatgtgtgaacaaccgctgaataaaacgcccgccgccctgcaaaaacgcccccacagccgggcgcacagcgaaagaggggcgggcgccgcagcgcccgccccagcctgtcgaaaaggtattttcgacaggctgctggactttttgaaactctaaaaaagtttcaaaaagtcgtttgatccaacgcgaaagggaaccctgacggttccctttcacactattcttccctccgaacacctcggcagaaaggcttaatggcaaccccaggcgggcgccgcagcgcccgcccctcttctgcattcacaccgccagcgcccagttaagcatcaacaggagcccaaagccgggcacgcccagcacgccgagcaccagagcgttgaccagattgacccccaggtggaggcccaccaggccgcccacaccgctcaacgcccacagggcggccaggcccacgcccgtccgcgcggccagacgcaccagccactccagcggccgccgcagggccgccaacagcaaaatcaggatcaacccgcccacaatccagggcagggcattgagcaaggtttccaccgccatcccctcccagctttcctctgccagtcccttggcggcgggttccccccgcagttatcccggctgcgcctgcgcctccccgtctagctccttgacccgccgcagcaggtaggagtaccgggcctggagggcattgatctcaaagacataggactcgatcagatccgggtccttggcggcgttaaagcccgcataggcctgggcaatgaggctgcgggtctgtcccagcccctccaacagcgcccgccgctcggtatcctccgcccgctcccgtcttttccgcaggaaaaacactctggcctcctccgccataacggcgcctcctttgtttttggtttcccatctcatggtatgtccagtctggacaaatatgccggagcctaaaccaaaattttccgcgtatggcgctccgtcctgtgcacatactatgcccggacaggaaagaggcctgttcctccttgcatctccttttaagccggtgccgggtgagctcaccctctggcgaaaggcgaaaggaagcgcaagctgtccaaacaaagccgcccgccccgcgacgaagcggggtcaggcgcagaaaggccgccggacaatgtccggcggcctttcgcgttttcttgacactttgggccggtttggagtaatataataagatgtaattttctgattttggaacgagcgaggagaggcccatggcgaaaagcaattcccccaaaaattacggaaacgactccatttcctccctgaagggggccgaccgggtacgcaagcgcccggcggtgatcttcggctccgacgggctggagggctgtgagcacgcggtctttgagatcctgtccaacgccatcgacgaggcccgggagggccacggctccctgatcaccgtcacccggtatgaggatcactccatcgaggtggaggacttcggccggggctgcccggtggactggaacgagaaggagcagaagttcaactgggagctggtgttctgcgagctgtacgccggcggcaagtacaacaacaacgacggcgacaactacgagtactccctgggcctcaacggcctgggctcctgcgccacccagtacgccagcgcgtactttgatgcggtgatccaccgggacggctttgagtacaccctccacttcgagaagggcgagaacgtgggcggcctgaaaaaggagccctactccggcaaaaagaccggctcccgcttccgctggaagccggatctggacgtgtttaccgacatcaacatccccgtggagtactacaccgacgtgctcaagcgccaggcggtggtcaacgccggggtcaccttccgcttccgcaaccaggtgggggggaagttcgagaccaccgacttccagtacgaaaacggcattgaggactatgtgaaggagctggcgggggagaactccctcaccctgcccgtgttctggcagaccgagcggcggggccgggaccgggcggacaagcccgagtacaaggtgaagctctccgtctccttttgcttctccaacacggtgcagatcatcgagcactaccacaactcctcctggctggagcacggcggctccccggagaaggcggtgaagtccgccttcgtgaatggcatcgacgcctacctcaaggcccagggcaaataccagaagagcgagagcaagatcacctgggccgacgtggaggactgcctggtgctggtgagcaacaacttctccacccagacctcctacgagaaccagaccaagaaggccatcaacaacaagtttgtccaggaggccatgaccgagtttctgcgggcccagctggaggtctacttcattgagaatcccctggacgcggggaagatcgccgagcaggtgctcatcaacaagcgcagccgggagaacgccgagcgcacccggctgaacatcaagaaaaagctctccggcagtgtggacatcgccaaccgggtacagaagtttgtggactgccggacgaaggacaccacccgccgggagctctacatcgtggagggcgactcggctctgggcagcgtcaagctctcccgggacgcggagttccagggcatcatgcccgtccggggtaaaatcctcaactgcctcaaggccgactacgccaagatcttcaagagcgagatcatcaccgacctcctgaaggtgctgggctgcggcgtggaggtgcacgacaagcacgccaaggacatggccgccttcgatctgatgaacctgcggtggaacaaggtggtcatctgcaccgacgccgacgtggacggcttccagatccgcaccctcattctcaccatgctctaccgcctcacccccaccctcatccagcgggggtacgtgtatatcgccgagtcccccctgtatgagatcacctacaaggacaagacctggttcgcctactccgacgcggagaagaacgagatcgtgagcggcgagctggcgggcaggaagtgctccatcaaccgctccaagggcctgggcgagaacgagccggacatgatgtggctcaccaccatgaacccggagacccgccgcctcatcaaggtcatgcccgaggacgtggagcgcaccgccgccgtcttcgacctgctgctgggggacaacctccagggcagaaaagaccacatcgcggagaacggctacaagtatctggagctggcggacatctcctgaccgggcatacggccgctatatagggcggctgaccgttccaagcagaccgtttcccgggccgtgcagcagttcaaggccgcggtcagccgtcggagcgcccggaaaggcctgtggcagtccggctattacggccctatcatccgaaaggatgccgatccggccgaaacccgccaatctatcgccgacaatcctctgaactggattctgaataaggactgataccaatgcccaaaaagaaggcccccgaggagggggcaaagaaggtaatcaaccccaacgtcatgggcctgcggcccgaggtgctggaacagcccatcaccgagacgctggagatcaactacatgccctacgccatgagcgtcatcgtctcccgggccatcccggagatcgacgggttcaagccctcccaccgcaagctgctttacaccatgtaccagatgcacctgctggggggcgcccgcaccaagagcgccaacgtggtgggccagaccatgaagctcaacccccacggcgacgcggccatctacgacaccatggtgcgcctcagccggggttacggggccctgctccaccccctggtggactccaagggtaacttcggcaaggtgtactcccgggacatggcctgggcggccagccggtacaccgaggtgcggctggaccccatctgcgccgagctgttccgcgacatcgaccaggacacggtggactttgtagacaactacgacggctccatgcaggagcccaccctgctgcccaccaccttccccaacgtgctggtgagcgccaaccagggcatcgccgtgggcatggcctccaacctgtgcggcttcaatctgggcgaggtgtgcgacgccacggtggcctttctgaagaacccccaggtgaacctgctggaccacctgaaggcccccgacttccccaccggcggcgagctgctctacgacgagggggcccttcggcagatctatgagacgggccgcggctccttccaggtgcgggccaagtggcgctacctcaagggtgaaaacctcatcgagatctacgagatcccctacaccaccacggtggaggccatcatggacaaggtggccgagctggtaaaggggggcaagatccgggagatcgccgacatgcgggacgagaccgacctgaacggcctcaagatcaccatcgacctcaagcggggggccgatccggacaagctgatgacccggctcttccgctccaccaccctccaagactccttctcctgcaacttcaacatcctcattgcgggtatgccccgggtgatgggggtgcgggagattctggacgagtggacgggctggcgcatggagggggtgcggcggcgcacctacttcgtgatgaagaagaagcaggacaagctgcacctgctccgcggcctgaaaaagatcctgctggacatcgaccgggccatcaaaatcatccgggagaccgacgaggacgaccaggtggtgcccaacctgatgatcggcttcggcatcgacggcgtgcaggccgagtacgtggccgacatcaagctgcgcaacatcaacaaggagtacatcctcaagcgcattgaggaggtggccgggctggaggaggagatcgccgacctccaggacatcgtgaacaaccccggccgcatcaagaagctcatcgtggccgagctccaggcggtgcagaagaagtacgccgtcccccggcggacggagatcgtctacgagtaccagaccgccgccgcggaggacgcggaggacgagaccccggactacccggtgcacgtgttctgctcccgggagggctacttcaagaagatcaccccccagtccctgcgcatgagcggggagcagaagtacaaggagggggacggcccctggctccagtgggaggcctccaaccgggacgagctgctggtctttaccgaccggcagcagtgctacaaggcccgcctgagcgacttcgacgactccaaggccagcctgctgggcgactttttgcccaccaagctgggcatggatcccggcgagggcttcgtgtgggcctgtgtcaccgccgactactccggccacctgctgttcttctttgaaaacggcaaggtggcccgggtggccctgtcggcctatcagacccagacccgccgcaagaagctcacgggcgcttactccgacaagtcccccctggcggcggcctgcctgctgacagaggacacggagatggcggtgacctccaccgagggccgggtggtggtcttccacaccgccgccctcacccccaagaccacccgctccacccagggggtcaacgtcatgaccctcaagcccaagtacaaggtggccgacgcccgccccctggcggacaccaccatcgtcaacgccgcccgctaccgggcccgctccctgcccatcgcgggcatgctgctccggccggaggaccgggccgaggagcagatgacgttactggaataaaataaagaaggtatcggctatgaatcgtgtcgcaaagcagtatgtccttccctatctgtggatcaccctggcgtctgcggtgtacgccgtgggcttcaactggtgctacgagcccaaccagatcggcttcggcggcatcaccggcgtgggccagatcatcaaccacatcctcccctgggctcccatcggcaccgtggtcatcatcctgaacatccccctgttcctgctggggtggaagctgctgggcgggcacctgctggtgtcctccctttactccatgttcatctcctccattttcatcgacattctccacatgatccacacctttgagcctatggagcccattctggggtgcatcttcggcggcgtgatcatgggcggctccctgggcgtggtgtttctccagggcgccaccaccggcggcaccgatctcattgcccgcctgctcaagctgaagctggcctggctgcccatggggcggctgcttctggcggtggatctgctggtcattgtggcggtggccgtcgccttccgcaacatctacagcgccctctacggcgtggtggccctgtatatctcctccttcgtcatggaccaggtgctctacggcatggacaacgccaaggtggcctatatcatcagcgacgcctacgaccagatttcccacgccattattcacgatatggaccggggcgtcacccttctccacggcgagggcggctggtccggggaggacaagaaggtgctgctggtggccttcaagcagaagcagatcgtggccctcaagcagaccgtcaagagcatcgaccccaacgccttcctgatcgtgtgcgaggcccacgagatcctgggcgacggcttccgggagtataagcacaacgatctctgagctgtccaggggcgggggaacgcgcccctggacaccccccgccctgcatatgccctgcttttttgcccgcaggcggataaccccctgtgctctgtcattttacgctggaaaggagacctgtttatgcccggttttgagaaggtacgcaaaaatctggaggcccacggcttcgatgtgacctgcttcgacacggcggcggaggccgcggactacctggaccgcaggctggacggcaaaacggtggggcacggcggctccatcaccctcaaggagctgggcctcctcgatcggctccagagccacgccgtggtgcgcagccactggctgggagacagcttcgcagacgcagccgccgccccggtctatctgacctcggtcaacgccctggcggagaccggcgagctcatcaacatcgacggcacgggcaaccgggtggcctccaccatcttcggccatgaggaggtctactttatcgtgggcgtcaacaagctggctcccgactacgacgccgccctctggcgggcccgcaacgtggcctcccccaaaaacgcccggcggctgggcaaaaagactccctgcgccgtccggggggacaaatgctatgactgcaaaagcccggagcgcatctgccgcgccctggtggtgctgtgggagaggcccaccggcatcggccgggccgaggtggtgctggtcaacgagcctctgggctactgaggagaggagggcgtggcattgaaacgaggcatggcggcggcgctggcgttgagctgcgccctgctgctcaccggctgctcctcccttctggagaacccctatgcagtggtggagccgcacacggagcgtccggccacggccgaggactcctccgccgtccaggcgggcacctattccgagctggtcaacaccgtgctgttttttgtctcccaggggacagaaaaggggctgattcagcttaccgacgactatgacggggatgtggaggaggatctcaaccgggcctgcctggaggtggccaaggacgaccctctgggggcctatgcggtggactttatcaaaaacgactgcaccaaggtgctcaccacctatgaggccaccattaccatttcctaccgccgcacccgggagcagatacgcagcttggtcaacgtcaccggcaccagcgccatccgggacgaggtgcgcgccgccctggctgattttcagagcgaggtggccctgcgggtgggctacttcactgagagcgccgactccattgccgccctggtgcggcaggcctactacgacgagcccgccggcgccctgggcatgccggagtttaccgtctccctctaccccgcctccggcgggcagcagcgcattgtggagatcctgctcacctatcccgaggacacccaggcgctgcgtcaaaagagcgatgacctccagagcacggcagatgccctggtgctccctctccggccccatcagctctccccctccgcccggcaggccgagctcttttccctggttcgggagcacgtccgcgcccggccggacggcggctccaccgcctgggacgccctgctgggcgacggggcggacagcgaggggctggccctgacctttcagctcctcagcgggaagatggaggttggctccgttctggtggagggtactctgaacggcgaaccccacttctggaaccagctcaccgccgacggcggcgcccactatgtcgatctcacccgcgacgcctccggcaccacctattccgccgccgatcttctctccctgggctacgtgtgggagggcgcggaagaaaatgcagaaaatttgaattaaccccttgacagcggcggaacggttcgctataatataatccgtcgcttgcaggtgtagctcatctggtagagcgccaccttgccaaggtggaggtagcgagttcgagcctcgtcacctgctccagaaacgaaaacgggacggccgatggccgtcccgttttcgtttctggattccgtagttcttttttatgctcggggcaactgaattgcccctccgccaaggttttgcctccggcaaaacacttgtgcgccgcacacgcggcggcccccgctatcggaaccgttcaaccgtcagccccgtcctttgctccaggaaagcgcgcagctcctccggggcggcgcctgtcagctcctccttgtcgcagagctggccgtggttctttcccagaatgagcaccaggtaacggtcattctccgccagccggaggagcttgctatattgccattgagtggccgcgccggcgattttggtctcatagtgttcctccaaaaagcgcaccgtgcacacctccatccccggcagggcgttccgcctggcaaagaaggcgttgattgcgtcctcccccagcagaacggccagcatcaggacggccaccgccccattgagcgccacagttccccactcgccccaggagacccaggccgacagcaggctcagcaccaggagcacccagcaccagacgcgcagcagccgtgagcgcgtcctgcggacggttttacgcagagccctggccagcgcagacagcgccctccggtcataagtggtactgcatatgatttccatagaaaaacctctctttcgtctgcgtgggtatagaatagcaaatatcccgcgccgctggcaagaaagattttcttacgattccttgaagcctctgtaagaaagaaccctatgcttcgggccgcccgagcgggcggcccgttttttcggaaaggagtctctatgccaagctcttccatcgaggccctgggccgcttgatctcccgccaggtggccgggcaccctgaccgtgcccgcgccctgctccgcacggcctacaccctggtgggggtacagatgaagtacttcccgcccaaaaacgtgctccccgcccggtgcgccatgcagggggacacggcccgctccatggccgccgccctgggccgccccggccgggcggcctgcgtcaacatcttcctcccctgcgaggtgctccacgccctgaacatccccccggtgctgcccgaggggctgtcctgctatctggtgtccacggcggcggagcgggtgttcgtggaggcggcggaggagcggggcgtgccggagagctactgctcctaccacaaaatcctgcttggcctggccgagaccggcgtcatggccaggccccggttcatcctcaacacctccctggcctgcgacgccaaccagctcaccttccgccggctggcggagttctgggacgtcccacgcttcacggtggacgtgccctacgccccctcggaggagagtgtcgcccaggtggccgaacagctccgggccatggcggcctttgtccaggcccacggggggcgccccctggaggaggacgcgctgcgggccgcggtggcccgctcccgggccaccgtggagggctaccaccgctacctgtccctgcgggcggagcgctccctctctgacgagatgacctccgagatgctctccgtcttcgccacccactccatgctgggttcgccggaggccctgcgctacaccgagcagctctgcgcccaggtggccgccctgccggaggggcggcgtggaaagcggattctgtggctgcacaccctcccccactggcaggacagcctgcgcgccctgctgaacttccgccccgacgtggagattgtggggtgcgacatggccctggatgccgatgtgctccccgagccggagcgcccctatgagtccatggcccggcggctggtctgctcctccttcaacggcggtgcggagcgccgggcggagcgggcagcggagctggcccgcctcctccgggccgacggggcggtgtacttctgccactggggctgcaagcagacctccggcgcggcccagctcgtcaaacgccggctggaggccgccgggttccccaccctggtgctggatggggatggctgcgacagcggcaacgtgaacgacggccagatggtcacccggctccaggcctttctggagctgctggagggatgcagatgatcggatatacctgtaaatacacccccgtggagctgctggccgccctgggcggccagccggcccttctcaaccgggaggctaacgccttctcccacgccgaggcgctgacccacaaccacttctgctgccacgccaaggcggtgctggaggagtgccgccgggacggcgtgagggagctggtgctggtcaactgctgcgactccatccgccgctgctacgacgtgctccgcgcccagggcgggctggatttcctcttcctgctggaccttccccaccacgacgacggctgcgccaaggcccggctccggggggagctggagcggctggcggcggagtacggggcctaccggggcgccaccctggacgaagcggccctccgggccgccttcgcgccccctgtccccctgccggacggccccttcctggccgtcaccggggcgcgggccggggcgggcctgctggaggccctgcggcgggtctcccccctgccggtggccgatctgacctgcggcggcaaccggagcctgccgcccccgccggaggggctggacggcctggacggcctgctggactggtacgccggggctctgctggggcagatcccctgcctgcgcatggacgcggtgggccgccgggaggagctgctgaaccaccccggcctcaagggcctggtgtaccacaccgtcaagttctgcgacttctactccttcgagtacgagaacctgcgcaggcgcaccgccctgcccctgctcaaggtggagaccgacttcacccccctgtccagcgggcagctctccacccggctggaggcctttctggaggggctggagctccgccccgcccctgcttccgccgcccggcggggggcctatgtggcgggcatcgacagcggctccaccaccaccaacgtggtggtgctcgaccgggcggggaacgtggccgcctccgccatcgtccgcaccggcccaaaggccagccagggcgcggagaaggccttcgccgccctgggcggcttcaccccggaggacatggccgccatcgtggccaccggctacggccggaacaacatccccttcgccaccgggcaggtgaccgagatcacctgccacgcccggggggcccaccgcctgtacccggaggcccgggccatcgtggacatcggcggccaggacagcaaggtcatctgtctggacgagtcgggcggcgtgaccaactttgtgatgaacgacaagtgcgccgccggcaccggacggttcctggagctgatggcccgcaccctggagctgaacctggatgagatggcccgcgtcggcctgcactgggagcaggagctgaccatctccagcatgtgcaccgtctttgccgagtcggaggtggtgtccctcatcgcggacaaccactccgccgccgacattgtccacggcctgaaccagtcggtggccgccaagaccgccgccctggccagccgcgcgggggccaaagggccctatatgatgaccggcggcgtggcccgcaaccggggcgtgacggaggcgctggaggcccgtctgggcgcgcccctgtggctcccccccgagccggatctctgcggagccctgggcgccgccctcttcgctctggacagcatacaataaaaggccgcggcccgcaaacagcgggccgcggctctcgttatatacgtttatttcccccggcgggcgtcgcagacgagcttgacgagctggatcaccagggtgggcaggaaggccagcaggacgatctcgcccaggttggcaaagccgaaggcgggggccaccataaagaggctcttgagcccgggggtgaagagcaccagcagcagaagcaccacaccggcaaggaaggccaggacggagtacttgttggtggatagcttcagccggaaaatggactcggagccccggcagttgaagccatggaacaggcgggccagagtgagggtagcgaaagccatggtggaggccatcacagcgtcgcccccctggtagcccaggtagaaggcgatcatggtgacgatggcgataagcaggccctggccgccgatgcgggccaggaggggccggttgagaatgggctccctggggtcccggggcttttggtccagcaggcccttccgggcgggctccatgccgatggcgatggcgggcagggaatcggtgagcaggttgatgaacagcaggtgcaccggctggaagggcacgggcagggccagcagggaagcgtagagcacgcagaaaatgccggcggtgttgcccgagagaaggaactggatggcatttttgatgttggcgtagacgctgcggccgttgaccaccgccttgacgatggtggcaaagttgtcgtcggccaggatcatggaggcggcgtccttggacacctccgtgccggtgatgcccatggccactccgatgtccgcctttttgagggcgggggcatcgttgacgccgtcgccggtcatggacacgatattgccccggcgctgccaggcgttgacgatgcggatcttatgctccggggatacccgggcgtagaccgaaatgtggggcaggcgctcgtccagctcagtgtcagtcatgccgtccagctccacgccggacaccgcctcgtccccgtcccggaagatgccgagctgccgggcgatggcggaggcggtcaccttgtgatcgccggtaatcatgatggtgcggatgccgccccgcttggcgtcggccacggcctggacggcctcgggccggggcgggtcgatcatggagatgaggccaatgaaggtaaagccgttctcatcctccagggtgagggggcgcacggcgtccagctccttataggcgaaagccagcacccgcaggccctccatggacagctccatgttgacccgggccagctcctccctccgctcgggggtcatctccaccttcccctcccgggtgagcaggtgggtggagcggttcagcagcacgtcgatggctcctttggtgaagagggtaggcaccccatcaatgtcgtggagggtgctcatcagcttgcggtcggagtcaaaggccaactcgcccagacgggggtgctgggcgcggtagctctcctcgtccacgccgaacttttcgcccagcatcaccagggccacctcggtgggatcgccgatggcggtgccctccttctcgttgttggtggcgtcgctggccagcagggccgccttgagcagcagcctctgtacgtcgttgaccaggctcagatcctctccctccagcagggagccgtcggcgtacaccttctgaggggtcatcttgttctgggtcagggtgcccgtcttgtccgagcagatgacggagacggagcccaggctctccaccgccttgagatccttcataatagcgttctggcgggccatcttctgggtgcccatggccaacacgatggtgacaatggaggacagggcctcggggatagcggccacggccagggccacggcaaacatgagggagtccaaaatgcccatgccggtgcggaagatggacagggcaaacaccaccgcgcagatggccatgatgaccatggccagcttggcggagaagctgtccaggctctgctgcaggggggtcttgcgctgctgggtctggttcatgagggcggcgatcttgcccagctcggtgtccatgccggtgccggtgaccagcaccgtggcccggccgtaggtcaccagggagccggagaacaccatgttcttctggtcgcccagggccacctggtcggcatcgatggcctcggccgtcttgtccacgccctcgctctcgccggtgagggaggactcgttgaccttgagggagaagttctccagcacccggccatcggccaccaccatgtccccggcctccagcaggacgatgtcgccgggcaccacgtcggcggaggggatctccacccgcacaccgccccgcatcaccttggccgtgggggaggccatggccttgagactctccagggacttctccgccttctcatactggacggtgcccaggatcgcgttgagcaccagcacggcgaagatgacgatggtgctctccacattgccggagaaggcggagatcaccgctgcgataatgagtatgagtaccatgagatccttgaactgctccagaaagacctggagcgtgctctttttctttccctcggagagcttgttggggccgtactgctccgcccggcggcgggcctcctgggcggacagcccctccgcggaggcgttctgcgcctccagggcctgctgcggtgtctttctgtaataggcctgtgtcatatcactcgttcctttcccagtgttctccggcggagaggcgacaaaaaaagaccttccgccaaccgctgcatgccacagcagttgtcgaaaagtcttgttaccgcattgggcgcatgccgccaggccggaaacccggaccgtggtgttgacggcataccttcaaactactcccttttcaactgctgttatcatagcatagtctcacctttaagtcaatctaattttccattatgggccattctgcccccccttataccttttccggttgacgggcgcaccggctttcgctatactgggagtacaattggtaaggatcaaaaaaggagagtcccatgcattcaaactttgtcaagcgcctgctcaaggcggcctgggttctggagctggtggtcgccgtcctcattctggccgtcaccctgctggagctgttccttctgggggagggaaccctttcccaggtgctgggggggagcttcagcgccgacgccttcttcgccgacgccatgaccatcgtggtgggcatcgaatttgtcaaaatgctgatgctccacaccccccgggcggtcaccgacgtgctgctctttgccatcgcccggcagcttgtggtcaaccactccagcgcggtggacaccctgctgggcgtggccgccgtggccctgatcttcgtcatcaagaagtttctccacaccgacggggatgacgcgcccgccggagacggccgcccctgaaggctggagaagcggaagccgctgggcttccgcttcttttttgcgcccgggtgaaagatttcccgcctctcaatcgtattaggggtgaaagcgctttgactcaatggcaaaggatgtgagacacatgcccgtcacactggaccgcggggaggccgaacggctggtgcacgcctattccgacctgatcctccgcctgagctacacctacctcaagagcaccgacgacgcccaggatatctgccagacggtctttctcaagctgctccaaaagccccaggccttttcctctccggagcatgagaaggcctggatcatccgcacggcggtcaacctgtgcaaggaccatctgaaaagcggctggcggcgcgctaccgtagccctggacgcggcggaggccgtacccgcccccgcggaggaggagggcagtcttctctccgccgtcaacctgcttccccccaaataccgcaccgttatttacctgtactactacgagggctacgccgcccgggagatcgcccagcttctgggcgaaaagcccgccaccgtttccacccagctcaaccgcggacgccagcagctccgcacactcttagaaagcgagggaatgacatgagcaaccgctatcgggattccatggaccggctccactttacccaggagcagaagcaggagatggtggaccgcctgatggaggccgggccggtctcctccgtccgccgccccctccggttccgccgcttcgcggcggtgggggtggccgccgccctggcgctcagcctgggggtggcgggggccaccggcgccctgggcagcgccggggacgcctttgccggcttgttcggcggcggccccgccgagacggagatcatcgaccgcatcggctaccccatcggggccagcgccaccagcaacggcgtcaccatcaccgccgatgccatcatgggggacacctactcctacgccatcgtctactccatccgccgggacgacggttcccccctggtcagcgacgagacgctggcggccggagccgaacgggatggcctgctccccctgagattccgcaattacggcactcaggtgcgcacatccggcggcggggcgcacggctcctcctggttctatgacgccgaccccgccgacaacgccatccagttcgtggagatgatgactcaggaccagcccctcaagccgggcaccgcctccgtcaagttccaggatctgtcggtctacacggacaacgactaccgcaccagcgagacactggctgagggcacctggaggctgaaattcgactttgcctttgaggactcctccatctccctgcccgccggccagtccttcaccctcaacggcatggacgccaccctggatggcgtcaccctctctcccctgtccatccaggtggactacaccgtccatcaggagctggtgtggagcgaaaaccgggagagcggccgggagaacgagtatgaccgggagcagagctaccgctactttgagtccctgcccgtggtgatcacctacaccgacggcaccacccaggatctcaccaacgccggcggcggcatcacccccggagacggggagaccgtctgccagaagagccggatcttcgacgagctgcgccccctggacgaggtggcctccgtcaccgtgggagacatcgtcctccccgtcagcgccggataaccgcccgtccataggccgcgcatatacccctataaagagatcatatagggcccggccattcccctgtgttataatagaggcagcaataacagacaggaggaatccctatgatgatccaaggcgttctgggccccatcgacaccgctgaactgggccagaccctgatgcatgagcacatcacctgtgccgactggtccatgcgcatgaatttcggcgcccgcttctttgagtttgaccaagtggccgagatcgccgcgggacagctcggcaaggccaaagccctgggcgtgcgcactgtggtggacggcacccccgtcaacctgggccgggatatccgcctgatccgggaggtggcccgccgcaccggcctgaacttcatcgcctccaccggcttctactaccaggaggagccctggctgtacttccgggacgaggaggagatctacgacctgctgatgggcgactgcgccgacggcatctccggcaccggcagcaaacccggcatactcaaggccggtgtgggccgcggcggcctcactcccctgctgcaaaaggtgctccacgccaccggccgggtggcgaaggagaccggcctgcctctgttctgccaccatgacccctccacggccgccggcggggcgattctcgacctgctggcctcctgcggcgtgcccgcctcccgggtgatcctgggccacagcggcgacaccgacaacctggagtacctgaccgccatgctggagcggggctgctggctgggcatggaccgcttcggcttctgcgaccgggacctgggcctggagccccgggtggacaccatcgccgccctgtgccgggccggctggggccatcggctgctgctcagccatgatttggccgcctacctggccttctgggacagttgggagaccaccaagcactccgactggctgcatctggaggaggattacaccttcattcaccgccgggtgctcccgcttctggaggagcggggcctgagccgggcggacatcgaccgcctgctgacgggcaatccctgcgccttctttgagggcgtttaaaagaaaacacaggagtggaggcccacctgggcctccgctcctcagcctgtcgaaaaagtcttttcgacaggctgacgaaccttttgaaactctgaaaaagtttcaaaaggtcgtttgatccaacgcgaaagggaaccctgacggttccctttcacactatccttccctccgacccctttgacaggagggtctattgacagcctgaggagcggaggcccacctgggcctccgctcctgttcgttatgccgggtagcgggtgcgcacggagaagccctcccgttccagagagctccgggtgatctcccggccccagtggatggagctgttgtagttgccctcggtgaccatcaccgagttctccttcttttccagcaccaccaccgtgtggtagtcgccgatgcggatcatatctcccacgcggatggcctcaaagctccggtgagtgcgggcgggcaacgtaccaaaggccgcatcactacagatgagggcaaagccctcacagccgtagccgccggagcgcagcgcctgggaggcgtaaaagttgtcgttcgtccaacgcattccctctgggtagtcggccttcagcgcggtaatggcggcatagaccgcctcctccgtgggaccttcgggctccggccgctccgggttttcctcccccgacacggtaagcagcaccgtcttgatatgtaccccgctgtcaccgccctgttccatcttcagcaccacagccgcctggccgggggccaccgctgtgatgaggccggtgccgctgaccgtcaccacctcccggctggagtcggaggtgcagtaggcgtcaaagctcagtgggccgggtacaacggcccccatagggaagccgtaggtgagctgctgccgctcccccaccgccatctcggtgcgctccacggtaaacgtgatgtcttcaagcgccgcaggggtggcggggccgtccaggcccacctccgcgccggcggcctggagctgcttggtcagacgcatgaacagggtcacgccctccgcccgggtcaccggccgggccgggttcatccgcccggcgctgtccccctccatcaggccgcaccgccgcatctcctccacgctctccgccgcccatccgctgatggaagcagtgtcctgaaagcgcgccggggcgccggcgtcgtcgggcagaatgacgcccttttcctccagatagcgcgccagcagggtggccacctgctcccgggtgatggtaccctccgggtgaaaggtagtggcggaggcgccctccaccacgccgctggcactggcccagtagactgcgggagcaaagtagtcggcagccgtcacatcggtaaattgccccgtctgctccaccgcgtccctgtcaatgccctccaggcggctgagtatggccacaaactggccccgattaagcacctcgccgccctcaaagctcctcccgaaggggagaatcaggctgttatccaaggcataggccgtggcctcccgataccaggcctctgcgccgttgtcgatccagcggtcatagtaccagtccaaccggtccacgtcccagtagtcccccgcggccagggcgggcgcggcggaacccgtcagcgcggccgtcaaggccaaagccgccagcctgcggccccagtgtcggttctgtctcattcaattgcccccttttccagtccgtttctgtcctctactttacgggatagcccccctctttgtcaaccggcagttcccgccaaatcagcagagcggccggtccgtagccggaccggccgctctgctttaccgctggtactcgaattccaggttatagagggagacgatgtccccgtcctgaattcccatctcctccagccggtcaaacaggccggactggcgaagcatcctgtcaaaccagtttcgggactcgtagtccccgaagttgacgttggccatgagccgctggagccaggggccctccaccagccaggtgtcgtcctcgtgggtgatctccaggggctcggacatgtccacctccggcgggcgctccacataggtgggctcgtacaccgtgatgggcggcaggtgctccagctcccgggcggcggcgtacatcagctcccgggtgccctgctgggcggcggcggagatctcatagaagggcaggcccaggccctccacatgggttctcagggcctccagagcggagcggtcagcggcaatgtccaccttgttgcccgccaccagcatgggacggttctccagcccggagccgtactccttcagctcggcctggatggcctcaaagtcggccaccgggtcgcggccctcgctgcccgacacgtccaccacgtggataagcaggcggcagcggtcgatgtgccgcaggaagtcgtggcccaggcccgccccctcagccgccccctcgatgatgccggggatgtcggccaggacgaaggagacaccctcctccacatacaccacgcccagattgggaaacaaggtggtgaaatggtagttggcgatcttgggccgggccttgctcaccacagagaggagggtggacttgcccacattggggaagcccaccaggcccacgtcggccagcagcttgagctccagaatcacctgccgctcctggccaggcaggcccgccttggcaaagcggggcacctgccgggtgggggtggcgaagtgcttgttgccccagcccccgttcccacccctggccagtacaaagcggtcggtttgggacatgtcgcagataatctcgcccgtctccgcgtcccgcaccaccgtgccgcgggggaccttgatgaccagatcctccccgtccttgcccgagcagcgcttgccttggccgtccatgccgttggcggccacatacttgcgcttatagcggaagtccatcagggtggacatatgctcgttgatctccagaatcacgctgccgccccggccgccgtcgccgccgtcggggccgcccgcggccacgtacttctcccggtggaaggccaccgcgccgttgccgccgctgcccgccttgacggtgatgcgggcggtatctacaaagggtgctgccataaaaacctccttgccacagggtggctcgtcccataggggcggcccttgcggccgcccggagcctgcgccccgataaaataagccccgaacgggaatccgtccggggctagtttacccatatttactgggcgatctcaacgatagagacctgcttgcggtccttgcccaggcgctcaaacttgactctgccgctcttcatggcgaacagggtgtcgtcgctgcccttgccgacattgacgccggggtggatatgggtgccccgctggcggaccaggatgttgccggccaggacgaactgaccgtcaccccgcttcacgcccagacgcttggcctcggaatcgcggccgttgcgggtggagccgacgcccttcttgtgggcgaagaactgaagaccgatgttcagcatggtgtcacacctccaaacttgtgtgttaaaaacgtcgccgtgacggaggtcattcctcctccatcacgctgatatggtcgggatactcctcgtgcaggctggcaaagtgaaccatgagagccgccagaagggtctgacaggtggtctcattggcctcgctcaggccgccggggattttcatggtgatggaagcgtcgctctcccgcaccttgaccgatgcccccaggcccagcacgtcgttgacggcgcactcggtcaggcggacggcgctggtgactgcggcgcagataatatcgcttccctcatcggcgtagccactgtggccctgcacggtgaagcccacaatgcgctctccctccatgtgaaaggtgacggtggtcatcttacacggagatcttgccgatggtcaccttggtgtagggctgacggtggccctgcttgcggcggtagcccttcttcggcttgtacttgaagacgatgaccttcttgcccttgccgttcttcaccacggaggcgtccaccttggcgccctccaccacgggagtgcccacggtgatcttgtcgccgtcgatgacagccagaaccttgtcgaaggtcacgttctcgccggcctcgctggccagcttctcgatgaacagggtatcaccctcggtcaccttgtactgcttgccgccggtctcgatgatcgcatgcatgtagtttcaactccttcattacgggctcgctgtcgggggaggaggtttccctcacttgtttgtcgcgctgcgcaccctccgcgacggccaacggctcaacactccgctgaaactgctgccagactgcgtccggcctgctctcagtctgcgtgttttgctgctgccctgctctcaggcgtctccgcgcttcgttcccattcaaagcggctctgatagtatatcagcacaaatctgataagtcaagcttttttcttctatttggttaccggctcacctttttccggtatgttgtcggctcaaaggctccaatggcctcacagacgccgcacacatccggccggtggtcgaagacagcgccacagaacacacagcggtaaccgtctactgtgaccacctgctcctgggacatgggttcggactcctttgccggatggttgcgcttgagccctgccaaggcactcataaaacggaattcatggtccttctcaatttgagaaatctgctcaaagagcaccgcgatctcgtccagcccctcctcgcgggcggtttgggcatagccgggatagagcttggtccactccccatattccccggtcatcgcctcctgaaggttgtccgccgtgctgccgatgccgcacagcctctgatacatcagtttgccgtggactccttcattctgtgccatccgctcaaagagctcggccacttcagcataaccctcctgccgggccttgtcggcaaaaaagagatacttattgcgggccatagactccccgctgaaggcattccacaggttctgctcggtacgcgtcccttttatatccatattgattctccttaaataataataattactattattatattatttttcttttggttgtcaagagaaaaattcgtaccgatcagcccgccataacggagttctgttgttggctgcgaccgttctgccgggatggcagcacctagtgggccagccgtccgaagtaccagccggtgacaccgtccttcttcaccagcgcccggtcggagatgcgccgcaccaccgagagggtgtcgccggggcgcaccgccagacggtagtcggtggagtcctcacaccgggtcactccccggtccacatagagatactcggtgagcacctccaagacccggccggtctccaggtggcggcagagggagagctccgccccccgctccagcacctccagggcgttgcggccccagcggatgtttaccgagtccgccgacggggcctgggggtccagggcggtggcggtaggcaggccgtcgtaggcgaaccaggagaaggccccgccgggcctttccggcagcaccagggcgttgagctggccgtccgccttgagggagcagccgccgtcgatggaggcgatatgccgcccctccgccagcagcggggcggcggagggaacgtgggggtgatagagggtcaccggccagtggcccacgatgcaccaccgccggaaggagtgtccctgggagagaaagtcgtcgtttttcatgcacttccaggcgtccagcccctccaggtgcgcctcgtcggccacgccgccgtggacgaagaggtagtcgggggtgagcaggatctccggcatggcctccaggaaggccagctccgggccgaagcgggcccgcaccacctcccgcagagcgggcagctcctccggcccccgggtctcgaagccggcggcgtgccccatctgcaccagcagacagcggtcccgccacacgtccacatagtggcggtagaaccgctcctcctcccctcgcgcggccacaaactcgctcaccaggttgtcgcagttgccccgcaggccgtacaccgtgttccactccgccagctccatgatgaaccggagggtggtgaggctgtccggccccttctccaccaggtcgcccaccagcaccaggatgtcatcggggccgtaatgggcggcggccagcacgcccttgagaaacggcagattgccgtggatgtcgctgatggccagcacccgccgcccctccgggaaggtcaggcgctttaccgttgctgttctcggcatagatacacctcgctttaccacgctctattttaccacagggggcggaaaaatgctatcgcccctttcccccgatttccaccacgcgctgcgcccaagcccggtagaagtccgcctcgtgggacaccagaagcaccgtgcccgggaaccggtccagcgcccgggccagggcctccttggccgccctgtccaggtggttggtgggctcgtccagcaggagaaagttgcagggccgcagggtgagcaggcacagcttgacccgggcctgctcgccgccgctcagcgtcgccacggcctggagggcgtgctcctgccggacgccgcaccgggccagcgccctccgggcctcctgccggtccagggcgggaaaggcgccggtcaccagctcctccggcgtccgtgttccatccgtccaggccagggcctgggggaaatagcccagcgccgcctgctccgagaagcggaagcgcccggccagagggggtagccggcccgccagggtgttgagcagggtggattttcccactccgttaaacccggtcagcaccaccttctgtccggcatgcacggagaggtccagcccctccagcaccggactgcggtaccctaccgacagtcccaccacctccaggtctcccgtccggcccgcgggcagcggctggaactcgaacaccggcggggcgctccggccctccggcgccgccagccgctccagacggtccagcctcttctgccgcccccgggccatcttcgcgttgcggcccgcccggtttttgcggatataggcctccgtccgcgcgatctcccgctgctgggcggtatactgccggaggtgctccccctccaggcactcctttttggcctgataggcggcgtagttccccggatacttggtgaggcgccgcccctccaccgcgcagacggcggtgacggcccggttcagaaaggcggcatcgtgggacaccgccaggaaggcccgctccagccctgtcagcgtgtccgccagccacgctgcctgctcctggtccagaaagttggtgggctcgtccagcagcagcacgtccggctcctccagcagcagcctggccaggagcagcttggcccgctggccgccgctcaattcccccaccgggcggtccagccccagctccgccagccccagtcccgccgccgccttctccacacgggtgtccacctcgtaaaacccacgggcctccagctcctcctgccgccgggccgcggcggccagggccgccccgtcgccctccgccgcccggtcgtacagctctgtcatggcccgctccagcgcgtagagggcccggaaggccccgtgcagcacctcccccatagtgtgctccgggttcagggcggcatactggtccaggcagcccacccggataccgccctgccacacaatccgccccccgtcgggcaccagttggccggtacacagcttgagcagggtgctctttcctgctccgttccggcccaccacgcctacgtgctccccccggtggagggcaaaggcagcattctgaaacagaggctgcccgccaaaggcgtgggtcagccccgtgatctccaacaaactcatggtattgcttgtcatcctttctgaaaaacgaaagcgggcagaggggccctcgcccctctgcccgcgctcctctgcggttcaaaaaagcgatggacgaaacatcgtccatcgcctgcaaaatgggtacgggaagccggagcgccctctgggccgccctaccgcttcccgatgaaacccaaccgcggttcagccgcgcagctctgcacaatgtttcaccggttcggattgtgcagagcggagtctttttacccgtttgtcagtcagatgaaagttcattggctgttctccttgctgtgatacgctctcaaccatagcacaggtccccggctttgtcaagccggggacctgcacggagaggcaaccgcctcaggcggccagattgcggacgatattgaagatggagatggccagcaccaggagctggacggcgttgaaggccttctccaccgccgcctcggagcacttcttgttgaggctggccccgataaagccgccagcgatggcgcccacgatcatcacaggggcgatggacaggtcgaacaccccgaagccggtggtgagggccacggtggtcagcttggagatctgggcgaagaggatggtcaccagggagcacaccgtggccgtcttggtgtcaaaggagaacaggtagatgatgagggccacgttgatgggcccgccgccgatgcccaggaaggaggagcagatgcccaggaagacgcccaccagcagggacaccaccacgccccgcagctcctggctggggatgcggctcttgttcttcatgtagaggaacacggccaagatgagcagggagagcaccacgttctgcaccacggtgacggcggagttggcccggagggcgtccacgatcacctggagcagcttctcccccgccagaccgcccatcaccgagcccagggccagggggatggcggtgccgaaggggattttggtacgggccagcatctgcttgccgatggacaccaccgacatggagaacaccgtcagggaggagagcacgccgatggtctgcacatcaaagccgtggagcacgtccatcagcggcttgatgatgacgccgccgcccatgccggtgagggagcccaccgtggtggcgccgatggcgatgaggaagtagagcacgtactgcaagggaacgccttctttcgatggaattcagcgccggctcagccgccgcagggggcgccgcccacgggggcggagttgagggcggggtccttcatgcagaggtggacggcggcggtggtgaaggtgcggggcagggccaggatgttggggttggggccggtgtacttgcgcatggcgtcggccagggcctcctcgaaggtggcgcgggtcttgaggcccatgccgcgggcgatgcccggctcccgggcgcccacgatgtagatggcgctggtgtgctcctcggccagatggccgcagctcatcatggagaagccgtggaaggggtggaaggcgttggcgaagcggtacttgcggatgtactcctccttggtggcgaagtactcgccgtaccggttcatgtcggggaggatgttcatgtagtcgtgctggaacaggtcgtacagctcccgcaggtagggccagcgctcgtcgtggaagtagccgtcgcagatggaggacacgatgaacacgcaccggtcgctcatgatgcgcctgtggcggatgacctgggcggacagggcctgcatcatctggatggggttggtgcccatgccgttgccgtagtggaagttggtgggcatgccgaagacgatgatgtcgtacttcttctccgcccagtggacgtaggtgcgcttgtccgccatcttccaggacacgggctgcatctccctggcccagccggagtgaatctcgatctggcggctcttggtgtccagcacggcgtcgcagcagaagaacttcttgcccatcttctcctccatccgcatgccctgctggtcgaacttgtgccgcatctcgctgttcgtggacacgggcacgaagtcctgccggtgcatgacctggggcacgtggtgggcggagatgctccgccagtgggagatgccggtggcgcagtgcttatagccgccggagtagccgccgtaggggttgccctgggtgtgcccgatgagcaccgccacgtccgcgtcgtagacgtacttgttcatgatcacgtggtcgccctgggcggtgtagccaaggtctaccaggtggtcgtagtcctcgctgtcgtggctggtgatctggccggtggggtagaactcgccgaacagctcggggcccaggatggtctgcatctcggccacggtggcccgggggtgcaggccgttggagaacagcagcagcacgtccttctgctccaccccggcggcgtacagctcgtccaggcaggcacggatggccaccttccggtggctggtgggctggttgccccccttgacgatgtccggaatgacgatgaccaccgacttgcccggcccggccagctccttcagcgggggcatgccgatggggttgcggatggacgccagggtagcggcgtacaggctgtcccagtcctggggcagacagggcggatccgctactgtctccccggggatgaagatatcggtgctgtcgggcagctccgcgcccagcaggccctgcccgtattcaaattccagtttcataatttacctccgtcctcaatggcccagatacaggcggatgatttccagatactcctcggggtagaagccgatctcgccgctgaaccgggtcagggcgatgaggccgccgtcgatgtccgcgatggaggccagcatggcggcgttgtccgccttgaggccgccgccgtacaccacgtccaggccgccggtgcgctccttgacgaagcgggcgatcttctcgatgtagggcttgtcggccggggtcttgccgggcccgatggaccagatgggctcgtaggcgatgaccacccggctcttgtccgtcccgtccaggccgatggcgagctggtcgcccagcacctgctgccaggcctcctgctcctcgctcttctcgccgatgcagtagagcaccttgagccccgcggcctgggcggccttcacctcctggttgagcaggcggttgacggcggcggtgtcggtgacgccggcctccgccaggatgcccgccttgtcgttgcgctcctcgcagtggccgatgaggacccagccgcagcccagggcggcggcggcgtgggcgggccggttggtggtgaaggcgccgaagttgccgcccactgcggtgtcggcccggaagaccccctggcagcccagctccacccggctgtcggcggtgcgggccgcggccgcgggaatcaggtgggcctccgggaagaagtccacaaactccgcttccgccgggtcatagcccgtcaggccctgctgggtcccggccacaatggccctgccccactcggccacgggggccaggcggttgaccccgcccagctccaccggcacgtcaaaacgcttgagattcaaaaaaatgtgtttcattcagttgacacccggctttcccaaattttgaaacatatagcccttgtagccctccacgcccggctggttgaaggggttgacgcccagcagcttgcaggagagatagcaggcaaagaggaagaaatagaacagcccgcccagggtgtgggcgtcgatggcggggatggagaggttcatgcaggggatgccccggtcgccgtgggcccgcatggtggcctggcgggcggtgttgttgatgtcccagaagtccatgcccgtcaggtagtcaaagtagtccttcttggcctcggggggcaggagcaccgacgcgtcgcgggcgcgcacctccacgaaggtctcgaagaggatgggactgccctcctggatgaactggccgatggagtggagatcctccgagttggaggccgccaccgggtacagggcgttgccctccttgccctcgctctcggcgaagagctgaatccaccacttggcgaagtaatccagccggggttcgaaaaaggagagcatctccaggcggtagccgtgctccagcagcagccggcgcaggcaggcgtagcgcagggccgggttctcctccgccggggcggcgaggagggtatcccgcatgtcccgcatcccctgcaccagcgcgcggatgtccaccccggccaccgccattgggaagagccccacgtcgctgcccaccgagtaccgcccgccgatggtctcggggaatgtgaggaacgtatagccctggtcgaggcagagctggtggagggtggagcccggcgtgccggtagcgaagatgcgctttgccgcgccctccgcgccgtagcgccgctccaggtactggcgcaacacccggaaggcaatccccggctccagggtctcaaagttcttggcgatgcagtcgatgtagatggattgatatccgtccagctcccgcagagtgcgggccatctcgcaggcggagatggtgttgcccgcccacagaatggcggggcccccctccggccgcagggccttgacggcggcccgggacgcctggttggagccgccgattccgatgaccacgaaggcatcggcgtcggcccgcacccgcgccgcctgctccagcaggaagtccacccgctcgggcccggccgcctcgtccacactgtgccagcccaggttgtcccggtaccgctcctctcccgccgccgcctcggccagcaggggcgcggcggcgcgcacctgctcctccagcgcgccgggggccagcaccggccgcgcgtcggtaaaggacagggtgatgccgtccatgctcagccctccttggcgtagcgggccgccatgtcctccagggtggccggctccaccaggggggccttgccgtagctgccgaactccacaatcagggtgcccacggcctccttcacgccacggcgcatggcgtcggtaatgagagccacggccccctcgtcgccagtgccgtacatgacggtgtccatgatgggcgccaggaaggcgcggggatcaaaggcatcccgcttctcgtccagcagcttccagacgccgcccaccctggcgtcctccttcagctccgggtggtcgcggaacagctcgcggaagttgcgggtgacggccaggcggatgtcggtgtccacgttgatcttgccgatgccgcaggggatggccgccttcagctcctccttggagatgccgtaggcgttctggatgttcccgcccagggcgttgatctcattgacgatatactggggaacggtggaggagccgtgggacaccagggcgccctggatgccctcgtggttcatgcactccttgatggcgatggggatctccttccgcagcttcacgtccttgcccttgctggcgccgtgcatggtgccgtagctgatggccagggcgtccaccccggtctttttgaagaactcaatggcggagagggggttggtgtaggtggagttggcggcaaagacgtggtcctccacgccggccagcacgcccagctcgccctccacggacacgccgcgggcgtgggcgtacttgaccacctcgcgggtgagctccacattctcctcaaaggggagggcggagccgtcgatcatcacggaggtgtaccccccctcaatggcggccacgcaggagtcgaagttcttgccgtgatccaggtggagcaccacggggatggggctttgctcggcaaacttcttcaccgcctcggcgatgttgcgggcccccttcttcttgtcctccagggtgccgtttgcaaagtccacccggccgcccatgaaggcgttggccaggtcggccccctgcagaatggccggggagcggaacatctcgtgtacggcgatgaccgcctcggcctgggccacggcgttgacgttgaaggccccctgggcatagccatatttcacggtggcgtccagaaccggacgcagaggtaccagaggcatagcaattctcctttcggttattcccttatcttgtatagacggtgcgcccgcccaccacggtgcgggccacctggtaatcgccgtccagcaggaccagatcggcgtcctttcccacgtccagctcccccttgccggcccagcccatgaggcgggcggggttggcggtcatgaggcgggagacggtctccgccccctccccggtgaaggccatgaggttgcgcagggcctgggccatggtgagggtggagccggcccggacgccgttgggcagcttggcgtccccgttctccacaattacgtcgttgactcccagcttgtaactgccgtcgggcaggccggcggccatgatggagtcggtgacggctaccacccggtcgtaccccttggccttgaggtagaggcgcacggtgcccgggtggaggtggcggccgtcgcagatggcctccacgtacacatcccgctccagggccacgccgaagatggcggggtcgtgctggtggaacagccgcatggcgttgcccagatgggtgaccgaacgcacaccggcgtccacacaggccgcgcactggtcgtagcccgcgccgctgtggcccatggcgcagacgatgcccatggcgttgaggcgggggatcagcccgggcacgccggggatctcgggggccagggtggtatagcgcacgtggccgccggaggccttctgatacttggcaaagagctccgcgtcggcggtgtgcatcagcaggtgctcgggcatggcccccttgtactcggaggacaggcaggggccctccaggtggacgcccagcagggccgccccgccgcaggggccgccctcgatgacctgcctggcctgctccatgcaccagagggtctgctccggcgtgtcggtgagcaccgagcacagccagccggtgacgccctgggaggcgaagaaccggccgatcgtgcgcaggccctcggcgtcggcggcgttcacgtccaccccggcggcgccgtgggtgtgcaggtccagaaaaccgggcagcacccgcaatccggcggcgtccacctccggcaggcccttctcattgtggtgcccgcggctcagggcggtgatgtgcccgtcctccaccgccatgtccaggggggtaaaggccccgttccacaggacggagccgtttttcagataaaaggagttgtccatggcggcctcctcaataggccgtctgggcggcgttggcgttgacgtagagcagggcgtcggggtggttctgggccagggtggcggggaacgcggcggtcacctcgccgtaggccgcccggcggcacacggcccggtgccagtcccggaacacgcccaggcgcagcttccgcgcccccagaatctctttcatgccaatggtgacgcacttcctgggcatatcctccagcgcgccgcccaggtcgcccacgcagttggtggccctcgtctccgggtggatgtccagcacccgggtggggagctgggcgaactgttcagccgtcaactccggctggggctcgttgaaggccaggtggccggtgatgccgatgccgccgaaggcgatgtccacgccgcccagctcctcgatcagggcggggatgcggcccaggtcgttgggatcggggaagacccgctgctcctcgggcatgagcagctccggggcgatcttgccatatacctcccgggccatgaagccccggaaggacaggggattctcctcggcgatccactggccgtcgtcggtgaggtactcgtccatgttgatgaaccagcagttcctcagggagagctgctcccggttgaccagccgcacgaagatggggtactgccccaccggtcccaccgggcagataaagacggtgggctttccggcggcgttgttggcgcggatggcagcgcacatctcggcggccatctcgtaaaagacctcgccggagtcgcccagcttgaggatggggagcttggcgcccttgcccagctcctgggcggaaatatgatagtagtccatagtcgtacctccttttgtcattgaaacaggtgctccaaattcatctggcggatcatcttgacgatctccttggtgcgggagcagccgaacttgcccagcaggcccttgatctgggtcttaatggtcaccacctccacgcagcggagcctggcgatctccgccaccttcttgtcctggagcagcagcttgaccagctcgtgctccgccggcgtcaggtgggccacgttgttgatgaagaaaatcagggagcgctcgctgcggcgcagacgggcgtactcctgcatgacggtgttctggatctttgggtccagctccgcccgcccctcgctggcccggcggatgtgctccagcagcctctcctcctcacagcccttcaccacatagtccaccgcgccggtgcccatggcgctggtgatcatgtcgtcggtctcatgggcggtgaggaacaggattttgacctccgggtgccgcgccgtgatgacctcggcggcccggatgcccgcgtcgatggtctccatttcgatgtccatcagaatcacgtcgcaggggacggtgtccgccagggaagcgatctcctctccggaggcggcggagcccaccacctccatatcgctctgggcggataccacgtcgcagaagtcctcccgcagcagggggaagtcctccgccaccatcacccggattatctttgccattgtgtgatcactccttctgacgggggtcgtagaggggcagcatgatctggaaccgggccccctccccgtcgcggctctccaggcgcaggcggcccaggtggctgcggacgatcttccgcacatagtacaggcccatgccccagttgtaattggtgtttttgctggtgacaaagggctcgaaaatcttgccctggcgctccggcgggatgcccgggccgttgtcctccacctccagcacggtccacatgcgctcggcgcggacacgaagcaccacctgcggctcctcccgccccgcctgaacggccgcctcatacccattgcacagcaggttgcacaccgcctcgctcaggtggctgagatccgccagcaccaatcggtcggtgcccacatccaggcgaaccggctggccggggtacttgccgtgaaaccgctccaccgccgcctccaccagcccctccaccggcacggccgtgagggcaatggagttgttcttgaccgtgcggtagagctcgtccatcctccgcagcattccctcgttcagctcgttgagctgaacggcgcaggcgcgcacctgcgccatgtccggagggtcccctgccaaagcccgggacagcttcttgtggagcacccggctggacaggagctggttctttaccccgtggacaaagacggatactccggtgcccgccgcgtcgaacttccgcttgaggatcatatcctgccgggtgtcgtcataggtaagctgggtatagcgcaccagattgtagctgcccagcaccacaaagaacaccgtgcacagacccaggatgatccaccccagggcgggcagcgccccgctgatgtagctgctgatgcccaggcggatatactcggagatgaacatgttgtagatctgtgccggatccttgctggcgtagagcaggtagagggtggagatactggcgaaggagagcagcacatagcgggtgttgcgcttgaaaactggcatggtggtggcatggtactcctggaaaaacagcagacccgccgccgccagataaaggatgatccaggtcagcgaaacgtgaatggtcagcggcaggagccagaagcgcccactcaccaccgtgcgaaacacggccggataataataaacgagggacaatgccggtaccacacatgccgcaaggcgcaggcttttcatcctgcgccggagggccgggatcatagtggcctccagtgcggcctgtagggcaaacaggggaaacagggagcggcctactgccaccacatagcccagccggtccatagggattggaagcgcatggagccacacctgcagctttggaaccagaaacaggaactcccgctgttgggctgctgtgccgccgatggccgcgatatagacaatgatgcccgcaaacatgaccaggttacacacactcatgcccagcaaatacagggagagcgagtccttacgccgcagagccacatacagcgatgtggccagacacagtatcagtacgagaatcagcacggtgcctctcccccctgcgtggattcagttctttattatatcgcgttctctccgccagtgcaacgcataacacaaagagcgccggggctccgccaaatacggagccccggcggggttggcagtcatttacttcgcggcgctgtaggcgtcgtaagcctcctgcattacatcaaagagcacatagtcctccacaggaacattctcggtaatggtgccattatccaggaaaatgccctgctgggtctcatagaccgtcttgatggcgtccatgtcgccgcagacctcggtgatggtctgccagtcggcctcgccaactgcggccagcatggtgtcctcgggggcgtccagctccttggccagcagcttggccatctcctcgggatgggcagcgcgccagtcatgagccttgtccagggcctgggcaaaacgcaccaggatgtcgtggttggcctcggcgtactcaggggtacaaatgtagctggaggggaagatggcgctgtccaggaagtcggcgttggtgcccagatccacgtagttgtcgcccagagcgttctgcagggtgacggtattgggggaccaggaggcggcggcgtcaatctgcccggagatcatggcggtggtcataccgtccacggtcatctctacggtgttgatatcatccatggtcatgccggcacgggccagggcctgctccagaataatctcagaggaggtgccggaggacacagcaacagtcttgcccttcagatcctcgatggtttcaatgcccttggccttgttgcccaccaccacatccgacagggaggtggtgtgatccatctggaagatttttgcctcgccctgaatgcacagcttatgggcaccgtggccgatctgggaaatgtcaatgtcgccggaggccatggcggcgatttcggcggggccgccctggaactcaaaggtctcaacggtcaggcccacttcctcaaagtagccctgctcaatgcccacaaacagggagccggcggagcccaggttgggcatgtacgccacgcggacggtggcgggctcataggtgggggtgtcggccgcgggggtctcggtgccgatggcaggggactcggtgttgggcgctggggactcattgttggcgggagtcccgcaggcggccagggagaataccattccgcaggccagtgcaagagagagcagtttcttcttcatgatagttcctccttaattatttatgatgatccggctcatcccggaacaatcatacttacttgcggacagagaggtactcctgatagacctgactccagatgtgattcttcagttccaggaatcgaggactcatcttggtctcctgatcgcggggataggggatgtcgatgtccacaatctccttgacacggccggggcgggcacacatgatgaccacccgctgggccagaatgatggcctcctctacgtcgtgggtgatgaagaagcaggtcttctgctccttctcccaggtgttgagcagctcctgctggagttgggtacgggtctgtgcgtccagggcgccgaaaggctcatccatcagcagcaccttgggattgaccgcgtaggcgcgggcgatggcgacgcgctgcttcatgccgccggagagctctttggggtaggccttggcgaagccctccagatccaccatcttcaaatacttgtgggccagctcctcggcctcctccttgctcttaccctggagcttgagcccaaactggacgttcttctccacggtgagccagggaaacagggcgtactgctggaacacgatgccacggtcggggccgggacctgtaacctctgcgccatctaccaaaaccttgccctcggtaggggtctccagtccgccgataatattgagcaaggtggacttaccgcagccggaagggccgacaacacagataaactcattttcatgaatatccatatccacgccgttgagggccaccatctcaccgttgcggccgttaaacttcttgacgacgtggtcgatatgtacctttactgctgaatggtttcctgccatcccgtaaacctcctctcaaggaatttcacaatcttttcaaagcagatgccgataatacccagaagaatgattcccatgagcattacgtccatctggtagtatccattggcctgctgaatcatcatgccgatgcccttgtcgccgcccacaatctcagaggccatcagagtggtcatggaggtggacaggcccagccgggccgcgaccaggatgaagggagtggaggccgggatggtaattttgaagaaaatgtccttctgcttggcgcccagtacacgggccgccttgatcagggtggtgtccactcccttgacgccctgatagatggtgataaccatgaccaggaacgcggcgatgaagatgacggtgaccttactgacctggcctacacccagtgctgcgatgatcaggaacacataggccagcggggggatgttgcggataaactgaatccagggctccaccacgtggcgaaaggggtcataccacgccatgaggaacgccaccgggatagatactacaaacgcgatggcaaagccggacagcacacgggacagactggcccacacatggccccacaaaacgccgctggcggccttactgataaaggcatccaccacagctttcggtgtagcgaacaccagtggccacgtataggcggcgaacagccagattgcaatagcaacggccagtgaaatgagcacccatacccagttgggtattttgctccagaaagacgattttttcagtcgcatcgaaaccgagcctcctttgttgcttctcagtatacaaaaaccagccggtttcgaaaagtatgaagttttatcatactttcccggtactgcggtaaaaaacccggccggagcgtttgctccggccgggctcatcgggaaccgcaggttcagaacagccgcgccatggacggcagctccggccccagcaggggccggcaccagccgcagaaggcttcggtcacgtcggtgccgccggcggtgaggtactccgccgggagcacccgctcgcccagcatgacctcctcaatgggcaccaggaaggtctcgcagcggtagggcgcggaggacacgcggcggaaggccaccatctgccccgtctccccggccagcaccgcccggcaggccgcgcggcccgcctcctctgcttcggcggcatccaccggggactgccaggcgatggaggcccgggccaggatgcccggcttctcgctgcgggccttgatgcccagccgccgcaccaccagctgcgccagatgggaggacacatctccgaagtacgtggagcgcccggtctggaagatggggggcacgatgggcttgccctcgtcgtcgtggagaccctcgctggccaccacgaccacgccgcccagcttgcggtacatatcgcccaccctgtccaggaactcgtcctcatgaaacggccgctcgggagggtagagcaggtggggcgcgtcgccctcctgctcccgggccagggcggcggcggccgtggtccagcccgcgttgcggcccagagcctccagcaccaccacgtggatgggcaggctgcgcacgtccacccccagctcccgcaccgtgcccgccatgtagcgggccacgctgccgaagccggggcagtggtcagtgacagcgatgtcgttgtccatggtcttggggatacccatgacggagatccccctgtcccggcacaccgccgccagcttgccgcaggcgtccatggtgccgttgccgccgttcatcagcacgtagcggatgtgcttctccgccaggatatccgccatgcgggcgtagtcctccgcctccagggcgtcccgggaggtgccgatggcggtggcgggggtggtgggcagccgctccagctcctcctcgggcacagagccgaagtccagcagcttctccttcagcagtccgccggtgccgcccacagcgccgtaaacatgctccaccaggccgctggcctgggcctcccggaccgccccatacagggagcagttgagcacggcggtggggccgcccccgtgaatgatgatcaggttctccttcaatggggttccctcctcgttttcagtccatttcatctcattataatgccgtccgccaaaatccacaaggaggatttctcgtcataccttttgacaaagaagggggtgcgcaccgtgctggcgcacacccccctcttgaactccgctaccgggccgcacgggcggccagggccacccagccgttctgctcccgccgctcaaacacggccaggccattccgctccagggcggcctccacctcgccggcccgggtgtcgatgatgccggagcacaggaacaccccgtccgtgtccaggaactcccccgccttggcggacaggggtatgatcacgtcggccacgatgttggccagcaccagggcgtacttctgccgggccagctcggccaccatggccccgtcggtgaggacgttgcccgcccgcacgttatagcggtcccgcccgatgccgttgagagcggcgttctcgtaggccacatccaccgccttgggatcaatatccactgccgtcgccgcggaggcccccaggaccagggcggcgatggagaggataccgctgccgcagcccagatccagcaccggctttccggggacggtgtaccgctccagccccatgaggcagagctgggtggaggcgtggctcccggtgccgaaggtaaggccgggattgaggtacaggggcgccttccccgccgggacgggctctccccgctcccactcgggcacgatgtagagcctctcccccaccggcatgggcttgtagtacttctgccaggagtgggcccagtcgttgtcccccaggctggcgggcgaatagggctggtcgatgcccgccagccatccctcaagctgctttctgccgtcggcgtcgtcggtgatgtagaacttcacccggcagacgcccttcatgcgggccagcaggccgtcgtccacgtagtcccagtactggcggttctgctccaggaaggtcttgaagtcctcctcgtcctcgatggccagcccggtgaccccgttgccggtgagccgggcgcacagggcgtccagctccgcctcggtggtgtccagggtcacttccagccacttcacgtcctccatcagcggtgcctccccaggaagaacagggccacggtgcccgggccggagtgggcgccgatgacggggcccacgttgttgagcaccacggtctgcacgccgaagcggcgcttcacgtcctcggccaccttgttggcgtcctcctcgcagtcgccgtggctgatgaagacggtctggcccgcggggtcgatggcggtctccgccatgtggtccaccagggccttgagggatgcattgcggccccgggcggtgcccacctttgtcaggtggccctcgtcgtccacatgcatgacaggcttgatggacagcatggtgcccagtacggcggtcgcggaggaaatgcggccgccccgcttgaggaagtggaggtcgtccaccgtaaaccagtggcacaggtgaagtttgttctcctccagccagtcccgcaccgcgccgatgcccctgccctcgttcttcatgcgggcggcgtaccacaccagcaggccctggcccagggaggcgcacagggagtccaccacatacaccttccgctccggatactgctcggagagctcctgggcggcgatctgggcggagtggcaggtggcggacaggccggaggagaaggccaccaccagcacgtccctcccctccttcaggtggggctctatggtctcggtgaagtcggacacattgaccgccgaggtggtggccatctccccctcccggagctggcggtagaagtccttcgggtcgatctcccggttgtccggccagttgcggtaggtcttgttcctcatggtaaaggacaggggcagcacctccacccccagttcctttaccagcgcgtccgtcagatcggccgacgagtcggtcagcaggacataatcattcatctgcaaattacctccagtattcacacataccgggcacgcccggttattttcggttcttctccggctggggccgccgctcccgcagcagttccagaatccgctgacaggccagccggtcggcatagctgcgcagagcgagggccagggccaggccgggcagctcctccgcctcggcgctgccgtccaggctgcccgccgtcacgtccagcgcccggtccagctcctcccgaaactgttcgtacagcttctggggcggccgcccctccgacgcggcagccagcagcagccccgcgtccttcaccgagagcacctgcttgagggcgcacagggcggtcagataggccaggtgggtgcgggagtaccgctttccctcggcccggggcatggccccgtccttgatgtagttgttgaccatggcggaggtaaggctctccccctccccatagtggatgagctgacggggcatataggaaatgagctggtccatatacaggccgatgtcgggaaatgcctcccactccaccgggcgctcacgctcgaggcgctccttcagctcgcggatttcctccacggacgcctcctcctttctggtttcaaacatgacgtatcaaaatattggtgttattatatcacatcggttttcggtaagtaaaggcccgcagggcatgaaaaagggccgctatggtcacataacaaaattatgtgaccatagcggcccccgatgcggttacatctcccagtcggcgtagtcctccgcctcggagtcgtccacagcggcggtggacaggccgggcagcatgcctctcagcttggccaccacggccatgatcttgtcccagtagagcaccgccgcatagagcagcgcgcccaggacggccagcagggaaaagagcttcacaagggccccgaacaacttcttcatggacagaaagcctccttctgcgttgacactctgtgccgtatgcttccagtgtacacgtttccggtgcaaaatacaagtgtcccctcccactttcttgaaacttttttcccttgtaatttgaggcaaaatagaatacaataagagaacaaatgggatccattctgcccccgctccggcgggtgtacgcttgcattttcccacggaaaggaaggatgcgtccatgaagctccaaaccgaaaagggcgagatcaccatcagcagcgacgtgttcaccaacatcaccggtgcggctgccaccaactgctacggcgtcaagggcatggcgatgcgctccaagacggacggtctggtgcatctgctccgccgggagtccatgggtaagggcgtcaaggtcacttacaacgaggactcctccgtctccatcgagctgcatattatggtggacaacggcgtcaacctgatggcggtaagccgctccatcatgagcgaggttcgctatatcgtcagccgcaccacgggcgccgaggtgcgcagcgtggatgtgtgcatcgactccatggtcatcggctgaaacggcccgcgcccatcgaaaggaaggaacaaccgatatgagagagagcattgacggagcgtcgtttgcccaggccatgatccatgcggcggcctccctcaatctgcagaagcagcagatcaacgaactcaacgtcttccccgtgcccgacggggacaccggcaccaacatgagcctgaccctcggcaccgccgcggcggagctgcgcaagaagcagccccgcaccgtgggggaggccgccgccaccaacgcctccgccctgctgcggggcgcccggggcaactccggcgtcatcctgtccctgctcttccgcggctttgccaaggcggtcaaggacaaggacaccatcgacggccgcgatctggccatcgccctggatttcggcgtggccgccgcctacaaggcggtgatgaagcccgccgagggcaccatcctcaccgtctcccgcctgacggcggccagggcagccgacgcggcccgccaaacccccaacgacccggaggccgtgctggaggccgccatcgccgagggacagctcgccctggagcacaccaccgagatgaaccccgtcctgaagaaggccggtgtggtggacgccggcggcaagggcttcctggtgatcctccagggcatgctggactccctgcggggcgtgcccatgcccgagggggacagcgagggggaggcgaaggcggagagcaagaccgactacgcggccattgccgcggaggagatcaccttcaccttcgacaccgtgttcattgtccgcaaaacctctccccacaaggggctggaggcctttgaggcctatctgaacagcatcggcgacagtctggtcatcggcgaggacgacgactgcttcaaggtccacgtccacaccgacatccccggcgccgccctcaccgaggcccagaagtacggcaccctggagctggccaagattgagaacatgcgcacccaggcggaggatctggccgccggccgccacatccagagcaccgacgatctggacgcggtggaggccgagctggaggggaatcacggggtacggaagatcgccccgccggagaagaagtacggcgtggtggccgtggcggcgggcgacggcctggccgcggtgttccgcgatctgggggccgacggcgtcatcagcggcggccagaccatgaacccctccaccgacgacatcctgcgggagatcgatgctacccccgccgaggtggtcttcgtcctgcccaacaacaagaacatcatcatggcggccgagcagtgcgtccgcctggtggagggcaagcaggtggtggtgctccccaccaagacgatcccccagggcatctccgccctgatggtgatggaccccgaggcggaggtggaggacaaccgcgccgccatggcggaggccatcggccgggtgcacacctccgagattacctacgccgcccgggacagcgacttcgacggctttgccatcaagcggggcgactatctggccctgacggagcaccagctcttcggcactgaccggaagctggagaagctgctccgccgcctggcggaggccgaggcccagcagagcgccgaattcatcaacatcttctacggcgaggacgtcagcgagaaggaggcccagaaggccctcaagctctttaccgagtgctgtcccaacgccgagatcaccttgctctccggcggtcagccggtctattactatatgatctccgccgaataagcccacgcaaacaagaaaaaggtacgcccctgcggggcgtaccttttttgtttctgcatcagagcaccttggacaaaaactccttggtgcgctcctccttcggattggcgaaaaaggcgtggggctcgttctgctccaggatgtggccgccgtccatgaacaggactcgggtgcccacctcccgggcaaagcccatctcgtgggtgaccaccaccatggtcatgccctcgtcggccagctccttcatgacctccagcacctcgcccaccatctcggggtccagggcggaggtgggctcatcaaagagcatgaccttgggcttcatggccagggcccgcacaatggcgatgcgctgcttctggccgccggagagctggttgggataggcgtccgccttgtcctccagattgacccgcttcagcagggagagggccagcgcgtcggcctcctcctgccccatgagcttggtcttgaccggggccagggtgatgttcttgcggatggtcatgttggggaagaggttgaagtgctggaagaccatgcccatctggcggcggatggcgtcgatattcaccttggggtcggtgatgacggtgccgtcaaaggtgatggtgcccttggtgggctgctccagcaggttgaggcagcgcaggaaggtggactttccggagccggagggtccgatgacgaccaccttctccccctcgcggatggtctcggagatgtcatccagcaccagattccgcccgaagcgcttggtcagatgttcaacggcgatcactttccctcagcctcctctccattttggaaaatacgatggacagcaccttggtgatgcagaaataggccacggcaatgatgaacagggggccgaaggcgtcgtaggtcttgctctgaatggcggagtacaccttggtcaggtcagtcagggcgatgtagcccaccacggcggtctccttcaccaggacaatgaactcactggtataggtgggtaggcagttcttcagcgcctgggggaagatgacgctccacatggtctgcaccttggacaggcccagggagcggccggcctccatctgcccgggatccaccgcgttgatgccggagcggtagatctccgccatataggccgacgagttcaggccgaaggcgatgaccgcaaccaccatcttgttgtcggtgacgttcagcagcacgacattgtacataatcagcagctgcaccaccacaggaatgccgcggatgatatcgatgtaggcctgggcgggccagcgcaggattctgtgccgggacattttcatcaggcagagcaccatgcccagcaccgtgctgatgcagatggcgcccagagtgatgcccagggtgacccccaggccgtccagatagagccgccagcgatcctccacgaggaacgcctggtagagtttatccccgaagccgaggagtccgttcataatatccacggaaagtctctgcctccttgttcagaattggaatgtgcgcgtggcgcaggagagcctgctccgcacagggcggcgcaggctttcccgtttgactggtttatgctgtaaattacgcggcgggcttggcgaccacgatggactggatggcctcgtagtagccgtcggtgaagttggcgttcttctcccgctcctcgtcccgggtcaggccggcggcgatgaagtcgatgcggccggactggagggcggggatcagggcgtcaaagtccatgttctcgatggtcagggtatagcccatctcggcgcacaggtactgagcaaagcccacgtcgaagccagtgggatcgccgttctcgtccaggtactcaaagggctcgaactcgcagttagtgcccatcaccagggcgcccttggggttctccacggtcttcagctcggggagctgggcgtcctcattcttggagatgtacttatccaccagagcgtcaaaggtgccgttctcctggagggtggccatggcggtgttgaactcctcggccagggcggcgcccgtgtcgttcttctgggtggcgatggcgtaggtctccgtctcctcggaggcggggaagtccagcaccatcagcttatcggggttagcgtctaccagggactgggcggggtgggtatccacgattacacagtccacgcggccgttgatcagctccatgccgcactgagccacggccttaaaggcgctgacctcggcatcggggatggcagaggccacatcattgccggtggtgccctcctgaacggcgattttggcgccttccaggtcggccactgaggtccagttggcgggactgtcggcggcgggagcgccgctttctgtcacagggggcgtgctgccggcgggggtttcgttggtgtcgtcgctgcctccggagcaggcggtcagcagaccgagggacagaactgcggtcaggccgagggcggccagcttcttacttttcatagtgcattctctcctattccttgtgtgccctgcgtgggcttttttgatgttcttattatacatcatattcataaaaatgcaatatttattcattcgtcaaagcacacaaaaaagaaagggcggagccatgcggctccgcccttttgtccaatcagagaggaatttaacccttggtagcgtggaagaacaggaagttgcccagcggggtgtagtacatgccgtggacatcgtccgccaccatgtaaggctgagagtaataatacaggggggcaatggcctggtcctcgcccacgagcagatcctcggcctggtgcatcagctccatacggccagcagcgtcggagtcgctcaggaccttggtcatgatggcgtcgtactccgcgttggagtagtgagcgtcgttgttgccgttgtcggtcatgaacatatccaggaaggacacggggtcgttgtagtcggcaatccagccgttgcggcagatgctgtagtcgcccttggaacgggtctccaggaacacgttccagtcctggttattcagagtgacctcaacgcccaggacgttcttccacatggactggagggcctcggccacggcctggtgcttgtcgtcggtgttgtacaggtaggtggtctcggggaagcccacgccgttctcataaccggcctcggccagcagcttccgggcctcctcgcagttggcctcatagtcgtccttggacacgctccagtagctgccgcccacggtgcggaaatcgtcgccggaggtaccctcggcgtctaccacgctcacgggcacccaggcgtcagcggcaatctcgccggcctgcgtcacttgctccacgatgtagttgcggtcgatagccagggagaaagccttgcgcaccaggggatcgttgaagggctccttggtgttgttgaagcaggcgtagtagctgcccagatagtcgccggggatcacggtgccgtcagtcagcagcgtggccatctcatccgggggaggattctgcatgtagtccaggtcgccgttcttgaacgcggtgagctgggcgttggcatcgtccatcagcttgaaggtcagcttctccagggtgatgctggaggcgtcatagtagttctcgttgggcaccatgacgatctcggcgtcgtgggtccaggaggccatcttgaacgcgccgttggtcacataggtgctgggatcctgggtccaggtggcgttgccctccacgatgtcctcacgcagaggcatgcagttggggaacgcgcagatgtccaggaagtaagggcagttgtaggtcagagtgacctcaaaggtgtgctcgtcgggagcggcgacgcccagctcctccttgggcagctcgccggcgatgatctcgttggcgttctttaccatggcgataatggtgttgtagggagaggcggtggcgggatccaccaggcggcgccaggagtacacgaagtcgttggcggtcacgggctggccgtcagaccacttggcatcctcacgcagcttgaaggtgtaggtataggtaccgtcctcattcggagtgacagtgggctcctcggcggccatgccgggctccagcacggcggtagcaccgttgcgcccgtcgccggagggatcgctgtccacccacttgtagaggccctcaaacaggtgggtaatcataacgttgccgtccacagtacggttcatgctgggatccatggtctcgggctcggacgcgaagcacacgttcagctcgttcgcagcaccggtggtgccggtctccacgggagtgctcccctcgggagccggggtggtctgggtatctccggtgccgcagccggccagcagggacacggacagcgcagcggtcaggcccagagcaaggactctgctcttcttcattcgctttgtacctccaatcaattgtgatcctctattttgtaccaaaatgcccaaaagcattgatacactatgtatcgctgccccgttccggggcagcggacaggggtacccctgtccattgcaaaaatacatttgtctttaatagtctacattatagcacatggcagacgctttgtaaagccgcactttaccagatactgtctgctccaaatcacggcaaggctctgaaatcagcccagcagatgacagccagcccagtaaagtcacggacatttcctgcgggaaatgtgtcgcttcgcttcaacgccgcgccttccagggggaaccagttccccctggatacgcgcctgcggcgcgataccccctccgctctccgagggggaccgaaaccgaccgtcacgtagggcgggggcttgcccccgccgtcggcaaaaccactgtgccggaacctcgcttaccccagcagatggcacgcagcccagtgcccaggcgcgtgctccttgaactccggcacggcctccttgcacttgtcggtggcgtaagggcagcgggtgtggaaccggcagcccttgggcgggtgcatgggggagggaatatcgccctccagcacgatgcgctggcgctggcggctgacctcggggtctggcaccggaacggcggaaagcagggtcttggtgtaggggtggagaggattcttgttgagctcatagctctcggccagctccaccagggagcccaggtacatgacgccgatgcggttggagatatggcgcaccaccgacaggtcgtgggcaatgaacaggtacgtcaggcccagctcctgctgcatgtcctccagcatgttgaccacctgggactggatggacacatccagagcggagatgggctcgtcgcagacgatgaactcgggcttgactgccagggcgcgggcaatgcccacgcgctgctgctggccgccggagaactcgtggggatagcggtttgcgtgctcggtgttcaggcccaccatgcccagcagctctttgatccggtcggtgcgctcggcctttgaggagcagagcttatggatgtccagagcctcgccgatgatctcgcccactgtcatgcgggggtccagagaggcggaggggtcctggaagataatctgcatcttgcggcggtagggcagcatattgacctgcctgcacttgggaaccttgacgtgctgcttctcaccgttctcaccggcgggccaggggtcctgtccctcgaaaatggtttcgccgccgtactcgatgcggccggaggtgggggtgtagagctggagaatggttcggcccagggtggtcttgccgcagccggactcgcccaccagacccagggtctcgccccggcggataaagagggacacgtcctccaccgcctggacgccgggcccgtgaacgcccttgaccggaaagtattttttcaggtggtccacttgaaccaggatgtcattcttctcactcacggccgctcacctcctgatcctgtaccggcttctcctgtccggccttgtcgagctgatcctgcacccgcagccagcaggcggagcggtggccctcgcccagctccacgtaggggggcatcttctgcaggcagatcttcatggcatgctcacaccggggggcgaaggggcagccctcggggggattgagcatgtccacgggcgtaccctcgatggggatcagccgctcatagctctcggcgtccacgcggggcatggagcgcagcaggcccacggtgtaggggtggccgggcttgtagaagatgtcgtctaccggcccctgctccacgatcttgccggcatacatgacggagaccttgtcgcagatctcagctaccacgcccaggttgtgggtgatgaagataatgcccatgtgagtcttcttctggagctccttcatgagctccagaatctgggcctgaatggtcacgtccagagcagtggtgggctcgtcggcaatcagcagcttggggtggcagatgaggcccatggcgatcatgacacgctggcgcatgccgccggagaactcgtgagggtactgcttcatccgcttggccacgttgttgatgcccaccagctccagcatctccatggcccgcttggcggcgtcggccttggagattttcttgtcgtgggcccgcagggcctcgatgagctggttgcccacggtgtaaacgggattgaggcaggtcattgggttctggaaaatcatggccacctcgctgccccggaaggaggccatctccttcttgctgaaggccaggacatcccggccctcgaaggtgatggaaccgccgatgaccttgccgggggactggagcaggcccatgatggagtaagcctcctggctcttgccggagccggactcgcccacaatgcccatgacctcgtcgtaatccaggtcatagctgatgccgctgacggccttgacctcacctgcgggggtaaagaaggagacccgcagatccttgacttccagcagcttgccggacttttcgttctgttccattgattgtctcctcctctcttatttcttcagacggggatccagggcgtcccgcaggccgtcgccaaacaggttgaaggacaggatcataatgctgatgatgatagcgggaatgatcaaacggtaggggtaggtgctgatgccgcccagcgcgtcggagcacatggagcccaggctggtcaggggagccagcacgcccacgcccaggaaggacatgaaggactctgtgaagatggcggacgggatctgcaggcaggtggtggccacgatctggccgatgcagttgggcagcaggtgccgcttgatgatccggccgctggaggcgcccagggcacgggccgcggtcacgtattcctgtttcttgagggtgaggatctggccgcggatgatgcggctcatacccacccaatacaggcaggcaaaggcaatgaacatgcccatcaggttggggcccaccttcttaaagaactccgccaggaagaagccctggtggtcggtgatgaactgggtgacatgggggcccatggccgtggcgatgagcaggatgatcagcacgtcaggcagggagtagataacgtccacgatgcgctgcatgaccacatccaccgtaccgccgaagaagccggagatggagccgtagagcgcaccaatgaccagcacgatcagcgcggcggtgaggccgatgatcatggacactcgggtggcaaacatggtgcgcaccatgatatcgcggccgtagcggtcggtgccgaacacatgggggaacaccttctcgccgtcggcgatgcgctgcagctcgtcgttggagtagccgaagggctgggcggagtagcccagggccttgtagatctcctcctcgctcataccctcgtactcggcgccgccgccggccttggcctgggcgcggatgagcgccttgtccttgctgctgagctcctcgccgcgggcggccgcctccgcttcagcggcggcaacggcctcgtcggggtcctgggaggaggtggcctccttataggcctgttgggcctcaagggagtaatgccaggggtagaggttctctgcgccggcgttgaactggtcgtatccgtagggtaccagcatggggccaacaaaagcgaacagcaccaacagtacaatcacgcccagggccaccatggccaccacgttcttgcgcaggcggcgccaggcatccgcccagtaggatacgctcttgcgctgctggatgaagtcctccttctccccgctggtagccggggcgaagtccgccgccgtcaggtcgttcagctccagcagggggtccacatcgggctgaagggagccaaagacagcttttttctgtttctctgccatttttactctcctttcgtcagatcgatgcgggggtccaccacgcggtagaggatgtcaaccaccaggttcatgatgaccaccagggtcgccaggaagatggtggtgcccatgatgatgaagtagtcgcggttctgcacggactgcaccagatagcggcccaggccgggaatggtgtagacggtctccaccacgaagccgcccaccagggtgaaggcggtgagggggcccaggtaggtgatgacggggatgacaccattgcgcagggcgtgcttgaagatgatcctgggagtcagcagacccttggcccgcgcggtcttgatatagtcctggcccagggcgtccagcatggaggagcgggtcaggcgggcaatatagcacatggggtaaaggcccagggccagacagggcatcaggtaggccttggccccctgggaggcgtcaaaaataacgttgatgcccatgaatttaaagggcgccccatcattgcagaaaagcatcagcaggaaggtggccaccacgaagccgggcatggacacacccagggtacacaccacccgtaagacgctgtccacccattttccccggttgtaggccgccagacagcccaatggtatgcccaccgccacggcccataccagggcgatgacgccgatctttgcggagagggggaacttctccgtgatgatgtccagcaccggacggtccttctgcatcttcagggagacaccgaagtcctggtccacgatgactcccttgaggtagcgcagcatctgaactccaagggggtcatccatcccgtacttggcctccatggccgccttctgctccggcgtaatcttttcgtcgttgaacgggctgcccggcacggacatcatcaggacgaaggtgacgcaggcaacgaccagaatggtgatgagggccatgatcacccgtttcacaatgtattttgccattctttcacttcccatattattctctgttcacgcaatcgaaactgccccatcgtaagtgtttctccattttatcgtaatttgtcccatgcgtcaagagtatggccctccaaatttgatggaaactccccctaatcttgcatgtgtccttcatacaaagacaattttccacttatctgtccacatattatttcgctgtcagacgcttttcgagttgtgccagccaaaaaaccgccttttttcatagtgtggaatttaaatattccgtatattattcacctattcgccctttttatgcaatttcggccgggcatgcaattcccaccgcttgaatcgcttttctgcataaattgcaaaaaggcgggcacggaccgatgtccgcgcccgccatgggccccgctcagtcgaagcccaggcccatatagccgtgggtgccctccccccagagcgcccgcttttcggcgctgtaccacttaatcatgccgaagggctggaggtagctacccttcatgccatcccacagggcaggggtgcgcacatagcagcgcgccccggggagcacccgttccagcgccgccagcccgcggcccatcttgtccggggacagcagcagctccttgaacagcacactctccccgtcggtgtactcggcggcggcgcagccctccccgccgtccacgctcaaccggtacagcccgccccccgacaggcggcccatgccctgctggtagcggatcagctcctccgggtagtccacggcgggcgccccctccagcaggcggcgccggatggcgttgtactcccccggctccacgggttctgcccggtcgccctccgccgcgggctggagcatgctcttgagcagctccagcttccgggtggaaaagcagggcgcaaagcccactgtgccgaagaatttgaacaggcttggctcggcgggcacagtggtaacgcagtccgctccccgctcggccagatagccgtccacgaagcggagaagctgccggccgtagcccttgctgcgcgccccggggtcggtggccagggcgtagatataccagcccgaggcggttccgccgccgggcagggtcaacgtctggggcagcagggccagcatggaggccagccgcccctcctccaccacctcaagaacgtcggctgaggccccgcagcactcgtagaaccagtcgatatagcggccctcgtccccgaaggccgccttccacagcgccttctgggccagaacctcctccggacggccgggacgcatctccaacataagctgctcctttcttatcgcttcaaaaaccgtcacttcataaccgccgtgtgcttttccaccatcaggtcggggtaatagctctgcttggctttgcgcaggccctccacgcccatgtcgtcctcccggttgaggtaccggatctccgggtggcgggcccgcacccagcgggcgaactcccggttgatcatggcgtaggccccctgaagctcgccgtaggccttctcgaagtgcacgtcgtaggtgtcggcggacagcctgtcgccgatggtgaaggccaccacctcgccgtatacccggatgaggccgccctcaaggcccagctcctcatagtgctccatggcggtgcgcagggcgattccctcgtctcccagatcccgctcctcggcgtctccctcccgctggagggagcggcggtaccactccttgtccatctccaggcactcgggcagggtggccggggtgatctcctcgtaggtccaggtggggttgttctctacaaagcggttgatgtggttgcgcttggcgtggagcttcttgccccccagctcggccagccgctccacctcgtaaaggtagtcgtagccgtcccggtccgcggtgtaggcgaaccggccggggaaaaattcctccagctccgccatctgccggggcgtgaggcacaccaggcgcaggggctcccccttctccgccgcgtcggcctccagcgcacggatgacggcggcaatgtctccggagcccgcagggtacatatagctgcaccccaggcggccgcacacatgggtcaccagaaaatcgtccacccgggcgatgcgctggttataggcccggctccagacgtagagattggtaaagttatagtcgcacccccggtagttgccccgggcgagcagttcatccacccaggccttgtccgccggggtgggcgcatggaattcgatcatgcaggtttcgtctccttaaattcctagtatgccgaaatgatatcacgcccgtccgcaaatggcaagcaaaacccgtcaggcaccgtcccaccggcagccgcccagctccacccggccgtcggcggtgaagggcaccccctctgcctccagcatcgcccgctggacgccggggccaaatgctggggtggtggagccgtcggcacgcaccacccggtggcagggcacgccgggcgtgcggcaggcccgcatggcgtggcccaccgcccgggaggccctgggattgcccagcatcagggcgagctgcccgtaggaggcgcacttccccgccgggatgcgccggaccagctcatagacccgctcataaaaattcatgtcaatgcctcctccgaataccgataacagaagcacggcggccgcccgaggggcggccgccgtaccgtattttccgttgtcctcaccagccggggtagacctggctcttcttgggcagcagcaaggccgccgccacatagagccacagccctgcggtgcccgcgaagcacagcgccacccagatgaggcgcaccaagttggcgtccacattaaagtactcggccacgccgccgcacacgccagccagagcgccgtgatccagccggtacagcttttttgtctcgttcatctgaaaatcctcccgaggtgatttcgaattctggacataggataccacgggaggggttaaaaagtccttcgggctttcttaaaaatccatgaaaattatttgccgtcctccaccagcatgaggcagccgtcggcgtcgtatctgagccgctgcacctccgccttggtgttgcgcacgatatcgtccatgcggatgccctcggtgatggtggcgatgaaggtgtaggccacgccgtggcgcttggcccggccggtgcggccgatgcggtgggtgtagttctccagctcgtcgggcacgtcgtagttgaacaccgcgtccacgtcgtcgatgtccaggcctcgggcggccacgtcggtggccaccagcaccttgatctcgccccgcttgaacttctccagggtcttctcccggatgcgctgctgaatgtcgccgtggatggcctcgcaggagatgccccgcatcttcagcaggccggccagccggtcggtcatgttcttggtgttgcagaaggcgatggcccgctcgtactccccgtgggtgatgagggccgcgatggtgtccagcttctgctcccggccatccagatcaatgcggtactgggtgatgtccggcttggactcctccaccgggcggacggtgatctccaccgggtcccgctggtacacccaggagatgtccatgacctcccggctgatggtggcggaaaacatgcccaggtttctgcggtgcttgagctgatccaggatacgggtcacgtcccgcacgaagcccatgtccagcatccggtcggcctcgtccagcaccacggtctgcaccttgtccagccggacggtgcggcgcttcatgtggtccatgaggcggccgggggtggccaccacgatctggggcttctttttcagggtgttgatctgcctgtcgatgggggccccgccgtagaggcagacggtgcgcaccccctccttgaactcgcacagatcccgcagctcctcctggatctgcaccgccagctcccgggtgggggccagcaccaggccctgcacgtcggcgcattccgggtcgatgtgctccaccatggggatgccgaaggcaaaggtcttgcccgtgccggtgggggccttggcaatgacatccttccactccatgaaataggggatcgcccccgcctggacgggggtggcctggacatagcccttcttttcaatggccctcatgatggcctcggacagccccagctccgcgtaggttttggtcccgttcacctgctcgccgttgatttccattcgggtacaaacatcctttcgtttcgttttgcctgattcaaggtccccacaggcagccgaaaccccgtttcgtacccaaacgcccgcctcaccgcgggggcgcgacctcaaatccatcggccggaagcggctccggcctgtctcgcgccaatactatatcatagccccgcccattacgcaagtgcgccgccgctcccgccgtgctcctccgcccagatctccagggcctcccgggccccgtagaggctcccgcggtaaaagtagtagcggctgctccggcgggcatagcggcggtagacctccagatactcgttcaggaggtaaaccccctccgcctccagccagggcagcagcttctccagcgtgcgctccatctccgtcaaaagggccgtgtcctcggggccataggccccctttccctcgccgtagggcgggcacgcctcaaaggccgattcccagtcattcaccatcttccccgtcctccttcatattctccagcgccacccgcgtcgcctcaattacaaagcgggaaaacgtcacgtttgtcccctggatcacctcgtccacctgctgaataatttcattgggaaaacgtatgttcttgggcgttgtctccggaatggagggcagttgaaattttcttcccatacaaatcaccatctctactgtatggcaatctgtgggctttgtaagcactacatattgtaaggcaaatcgtaaagcacggccgctcctctccgcgtaggggcgacccttgtggtcgcccgcgggcggccataaaggccgcccctacaagggcttgtcaccaccgtcggcctttcgtaggcgccgatgcccacatcggcccgccctgcaccgtgtcggcgcgccttccatactccccctctttatatctgctttcttgtcatgcctccggcggccccgctttcttgccgaagaaagcggggggaaagacgggtcggggcgggggattccgatttccccccccccgacaccccaccccttgaaacggccaatcaggggggctgcggcccccctattggatgtaccccccaggaagggagggtatgccagcccatccggagcggcgggggcgttacaacgtaagcccccgccgtcggaaagccgccagcaggacggctcgggggaaactccaagaagggggaatcgcaattcccccttcttggtcgtttcaagggggatgggcgttgggaagggggaaaatcgaaattcccccttcccaaccggctctttcgcccctttctggccgctcagaaaggggcccgccggaggcttgacaagaaagcaggtgtcaaaaagggttcccatggaaggcgcgccagcccggcataaggcgggccgatgtaggcagaaggtgaattgcctcagagaggcaaaagaggccgcccctacagttgaacgcacagcacataaaacccggccagtgtccggcccctacctgcgccggaacacatggacgcggaaggaggcccgtacccgcagaccgtccagggcggccagccgctccgccccctccctgggggtcttccagtaatagggggtcatctggaacaggtcgcgcagcgcctcccccgccacgtccaccaccgcctccaccggctccacccgctcgtaggagaagccctcgtaggggacgtcctcctcccggttgcggtagggctggtcgtagagcacctgcttgagctcccacaggtggtcggcggcgggcaccacatagaggaaggccccgccggggcggagcacccgccggaactcgtccagggccaggggggagaagcagttgagcaccagccccaccgaggcatccgccagaggcagatggtaggcggaggccacggcgaactccccctccggcacccgccgggcggccaggcgcaccgacggcttggacaggtcgattcccgccaggggcgggcggcccagggcctcccacagtccggcggtgtagtacccctcgccgcagcccgagtccagcaccgcctcccctggcggggcgtactccgcccccagggcgcacagggcggccagcaggtggccgtagtatcccccggagagaaaccggcggcgggcctccgccatgcccttgtcgtcgccgggggccttggagtgctttttgttggcgggcagcagatggacatacccctctctggccttgtcgtaggcgtggccgttggggcaggcataggcccgctccccccgctccaggggggcggcgcagatggggcaggtaaacagagacttttccacagaacctcgctcctttgtggaaggtatgacaggaaattgggcctccgcacgggcgggggccccggccgttcacccctccagcagctccttgccggagatgccgggctccgtcatggagtaggggtccagaattttgtccagggccgcctcgtccagcaggccctcctccagaatgagccgccgcactggcgcgccggtctcgatggcccgcttggccacctcggcggccttctcatagcccacgtgggggcacagggcggtgatgatgcccacgctgtgctccaccatgtcccggcaccgctcccggttggcggtgatgccggtgacgcagttgtccacaaaggtatgtaccgcgtaggtcagggtctccacgctctggatcaggttgtagaagatgatgggctcgaaggcgttgagctccagctggcccgcctcggcggccatggtgacggtgacgtcgtttccgatgatgttgaaggccacctggctgaccacctcggggatgacggggttgaccttccccggcatgatggaggagccgttctgccggggcggcaggttgatctcgctgaagccgcagcgggggccggaggacatgagccgcaggtcgttggacatcttggacaggttgacggcgcaggtcttaaccgcgccggacacggccacgagcccgtccaggttctgggtggcgtcgatgaggtcggaggcctgcaccagctcaagcccggtgaccttggacaggttggggatgatgcggcgcagataccgctcgtcggcgttgatgccggtgccgatggcggtgccccccatgttgaggcggcgcatctcgtccttggcccgctcgaagcgggcgatgtcccggcgcaccgcccggctgtaggcccggaactcctgccccagacggatgggcaccgcgtcctgcatctgcgtgcggcccatcttgagcacgtcgtcaaactcctccgccttggcctccagggcctcagagagccgctcgagctggatctgggcccgcaccagcagcttgagcaccgccagcttgcccgccgaggggaacacatcgttggtggactggccgtagttgacgtggtcgttggggttgaccagggcgtagtcccccttctccccgcccagcagctcgatggcccggttggcgatgacctcgttggcgttcatgttcaggctggtgcccgcgccgccctggatggggtccacgatgaacgcctcgtggagccggcccgccgcaatctcatcgcaggcccgcacgatggcgtcggccacccgcttgtccagcaggccgatctccaggttggtgatggcggaggccttcttgatctccgcgatggagttgatctgctccggatgtacggccagcccggtgatgggaaagttctccgccgcccgcagggactggacgccgtagtagacgtccttggggacagacctctcccccacggagtcgtgctcggagcggtattggatgctcatggtacaggtgcctcctcgcaagcagtccttcattttatagggacatcatagcaccatccgttttattttgcaagcaatcctgcaaattatagtccctctccgtgccatgggcaggtcaccagatggtcgttgatgagccccgccccctggaggtaggagtagacaatcaccggccccacaaagcggaagccccgctttttcaggtcggcgctcacccggcgggacaggtcgtcctcggcgggcatgtcctccggccgctccagccggtggtccaccggcacgccgtccacccagtgccagaggtagcgggcaaagctgccccactcctccgccacggccagaaaggcccgggcattggtgacggcgcagcgggccttgctcctgtttttgatgacgccgggggcggccagagcggcctccacctcgtcctccccccacccggccagcgctgccggctcaaaatccgcgaaggccgcccgcagggctgcccgccgctccagaatcagcttccagctcagcccggcctgaaagccctccagctccagcagctcgaacagcgcctggtcgtcccggcagggccggcaccactccgtgtcgtggtacaaaatctcatgctccgtttttgcccagggacagcgcgcgccctctcccatgtcagctctctcctctcctttcccgcccggttgggccgggaaacgcgatatcatctgcactatagcatagaaatgggaaaatggaaacccgccggcaaagtcattgctgagaaaaaattttgtaaataaagaaaaaatcaggtgacttgccaggcggaccgtgttaccattaagataccagccaggggacatggcctggcaaatataaaatcaggaggacccctctcgtatgaaaaagcaccgcggaagacatctgctctccctgctggcgtcggcagctctgctggcatccctgctgcccgccgcctttgcggctgaggcagagggcgagaagcacatcaccatcctgggcacctcagacatgcacggaaatatctggggctattcctacgaagacaacgcggagaccgacaacaacggcatggccaggctctacacctacatccagcaagtgcgggccgagaaccccaacaccttcctcgtcgacgccggcgacgacatccagggcaccatcatgaccgacgatctgtataacaagaccccggaggagccccatccggtcgtcaccgccatgaactacatgggctatgacgccatgaccctgggcaaccacgagttcaactggggcatccccaccatgcagtccattctgggacaggccagcttcccggttctggccgccaacgtcaccggcgcccagggcgagccggtcaccggcgcgggctggacgattgtggagcggggcggcgtgaagctggccgtcatcggcgtggtcaccccggatgtccccatctgggacagcggcaaggacggcattgacgacgccgtctatgaggccgccaacgtggccgtcggcaaggccatcgacgagatcggcgaccaggccgacgtaatcatggtgtccgcccacatgggcatgtacgccgaatttgacgaggagggcggctccgactccgcccagaagattctggacgacaacccggagatcgacgtgctccaggtggcccacaaccacgtggtggtcaacgagaagcagggctccaccgtcatcggcggcgtgcgcaacggcggccgggacatcgcccgctttgatctgaccctggacgccgacaatcagatcattgacagctcggtggagattgtggatatgaccggcgtgacccccagccaggagctccgggagatccccctggtggccgaggcccatcagaagaccatcgactacatcaacggcggcggctccggcgacgagggcgagggcggcgcgtccctgggaagcactaccgcccgcttccagcctgagaacgagatccgcggcatccccgccggccgggtgatggataccgccgtcatggatctgatcaacaccgtccagctggagaactccggcgccgacgtctccgccgccgccctcttcaagggcaccagcgatctgcccaagggcgacatcaactacggcaacatcttcgacatctacaagtttgacaacaccctttaccgggtgagcgtcaccggcgcggagctcaaggcttacatggagtggtccgccgagtgctacaaccagtggcaggagggggatatcaatatctccttcgaccccgagtaccccgactacctctacgatatgtttgccggcgtggactatgagatcgacctgtcccagcccaagggccagcgcatccagaacgtcatgttccacggcgcacccctccaggacgaccaggagctgaccctggcggtgaataattaccgctactcctccgccctgaaggcccagagcattatctccggcaccaaggagtgggagtcctccaactccatccgggatatgatcgtggcctactttgccgagcactcccccgtggcccccgaggtggaccacaactggaagatcgtgggcgtggatctgagcgaggacgacccccgtcgggcggagctggtgggctacatcaacgccggcctgctggacaccccctacgccgagagctacaacctgtccgactatgattccctggtggcccaggccaaggcaaaggccgagactctcaccgtgaccgtaaacggcgcggccaaagacgtggccacggctttcgacgcccaggggaatacctactaccgcctgcgcgacctcgcctttgccctgaagggcaccggcgcccagttcaatgtgacgtgggacggcagtgtggccgtcgccaccggctccgcctacgagggcgaggccctggccctgcccggctccgcccccaccggcgaggccgtcagcctgactctcaccgtggacggcactgcggtgagccagcccgccgtactcgtcaacggcaactactatctggccgaaggcttcctcgcccagctgggcgcggagtccgccctggtggagggcgttttggccatcaccgccgcgtaaccgctttccgtcagcaaagggccgcgcctggggcgcggccctttccttgcgtattttaccggactccgccagagctttgaacgatccattcccttcatacggccgtcttgtccaatttttctctggcccctttgagcaatctgtgatataatccgctccgtatgatgattttcgcataaaaaggagtacgacatgattacagtttccgacctgggcctggcctacagcggccagcccctcttttcccacgtggatctccagttcaccaagggcaactgctacggcatcatcggcgccaacggcgcgggtaaatccaccttcctgaaaatcctctccggcgagctggagcccacctccggcgaggtctccatcctgcccaagacccgcatgtcggtgctcaagcaggatcagaacgcctacaacgcctacaacgtcatggacaccgtcatcatgggcaaccagcgcctctacgacatcggcaaggagaaggaggccctctatgccaaggaggagatgaccgaggccgacggcatccgcgcctgcgagctggaggaggagtacgccgagctgggcggctgggaggccgagagcgacgccagccgcatcctccagggcctgggcgtgggcaccgagttccattccaacgacatggccaccctggacgcccggctgaaggtgaaggtgctgctggcccaggccctgttcggcaatccggacatcctgctgctggacgagcccaccaacaacctggacatcaacgcggtgaactggctggaggacttcctgctggactttgagggcacggtgattgtggtcagccacgaccgccacttcctcaacaccatctgcacccacatcgtggacatcgactacaacaagatcaagatgtacgtgggcaactacgacttctggtacgacgcctcccagctcatgcagaacctgatgaagaaccagaacaagaagaacgaggagaaggcccaggagctgaaggagttcatctcccgcttctccgccaacaagtccaagagcaagcaggccaccgcccggcgcaaactgctggagaagatcaccctggaggagatccccgcctcctcccgccgctacccctgggtggccttctctcccgaccgagaggtgggcaaggacatcctcttcgtcaccgacgtcagcaagaccatcgacggagtgaaggtgctggacaaggtgagcttcatcgtgggccacggggacaagatcgccttcgtgggcgacaacgagaacgcccagaccgccctgttccagatcctcaccggcgagctggagcccgacgagggcaccgtcaagtggggccagaccgccaccttctcctacttccctaaggacaacaccaagttcttcaaggactgcgacgacaatctggtggagtggctgcggcagtggtcttccgacccccacgaggcctatctgcggggtttcctgggccggatgctcttctccggcgacgaggtttacaagcccgtcaaggtgctctccggcggcgagaaggtgcggtgcatgctctcccggatgatgctctccggggccaacgtgctgctgcttgaccagcccaccaaccacctggatctggagtccatcgccgccctgaacaacggcctggaggccgtcaagtgcaacgtgctcttcgcctcccacgaccaccagctggtgcagaccgtggccaaccgggtgttcgacttcacctccgacggcaagctcatcgaccgcaagatgacctacgacgagtacctggagagccagaaggccgactgattgaccggaatagcaaaaaccgccgcggactggcgttccgtccgcggcggtttttttatccctccggcgcgcaggccgtttccgccggaaggggttttctccggtagagcaccagcccggccagatcggccagtacccagccgatgggtaccgcccaccagatgcccttcaggcccacggcggggatgggggccagcaggtaggccagggccacccgcgtccccagggagaccacggtgagcaccaccgacacgccgggccgccccaggccgcggaacaggccgtagagcaaaaacaggatgccgatgccgcagtagcacatgccctcaatgcgcaggtactccacccccacggcgataatctccgtctcgccgggctccacaaacaggcccatgaggggggcggcgaagaggcacaccagcagggagctgaccaggcagaagcccacggacacccacagggcggagcggatcccctttcggatgcgctccgccttctgcgcgccggtgttctgggccacgaaggtggagaaggcgttgccgaagtcctggacgggcaggtaggcgaaggcgtcgatcttgacggcggcggcaaaggcggccatcacgttcaccccgaaggagttcaccagcccctgcaccatcaggatgccgaagttcatcaccgactgctgcacgcaggtgagcagggagtagttcatgatgcgccccagctccccccgggacaccttacagtgccgccgctccagccggagcaggggcacccgccgccagccgtagagggcgataccggcggcggacaccccctgggcgagcaccgtggcccccgcggccccggccaccccccagcccagtcccaggacaaaccagagatccagcccgatgttgaggacggtggacacggccagaaaggccagcggggccacggagttgcccaccgagcgcagcaggcaggcgaagtagttatagaggaaggtgaagcagacgcccagcagcaccacccgcaggtaggcccgggtctcgtcccaggccccggcggggatgcgcagcagggtcatcaccggctccagcagggccagcactcccacgttgagcagcaccgccacagcgccgataaacacaaaggaggcgaagaggcaccgcttcagctcctcctcccgctccgcgccgtagagcatggaccacagggcgccgctgcccatgcacaggcccagcagcaccgaggtgagaaaggtcatcagggtaaaggagaaccccaccgacgccagggccgacgcccccagcgcccggcccacaatgagagtgtcggcaatgttgtagcactgctggagcaggttgcccgcgatcatgggaccggcgaacagcagcatagggcgggtgattccaccccgggtcaaatccatctgcattggctcacgcactttcgttttgaatgttttatctttcttttcgtaagaatcatagcaaatccagaggaaaaatacaaggctatacttgccttttttcttcagccgggataagataacaaacacagcttgacagatagagggggcggaggcgttgtttttaagtggtctggacgacatcgaccggcggctggtggagctgctcatccacaacgcccgtatgtcctactcagatctgggccaggcggttgggctgtcccgtgtggcggtgaaggcccgcgtccgcgccctggaggagcggggcgtgatcgaggagtacaccaccattgtcaatccccagaagatcagcggtgctgtgtcctgctactttgagcttgaggtagagcccgcccaattcagcgcggtggtggataccctgcgcgccagcgataccgtgacccagatctaccaggtgtccggccgcaacaagctccacgtccacgccgtggcggctggccagggggaactggaggactttctggaccgggtcatccaccgtctgcccggcgttgccagcctgagctgcaacatcatcctctcccgcatcaaggacatcaagggcctgcgcctgtggcaaatgtcaataggtaagcgtaacaaaaagtaaaaaaattttcaaacgcccccaaaaatctggttgaacaggtctgcgctgctataccaccccaggatcttgcgggggtatctgttcagccagtcctccaccatgcggacctctttgggggaaactctgtcgaagttggttccttttgggaacttccgccggatcatctggttttgcttttcgttgctccccctttcgctgctgcaatagggatgacagtaatacactttggtgcgctggccgcctgccttaaatatggaggtttccatgccctcgcagttggaaaactccgtgccattgtccacggtaatggtcttgaacacttccgggaacatttttccgtatttccgctccagcgtattcatggcccgcaccacgctggcggcgctcttgtccgggatcaggcgcatgatttcctggcgggtcacccgctcggttagggccataaggcacttgtggccgccgcggcaggacaccaccagatccatttcccagtggccaggctcttggcgtgtgtttacctcctccggccttttctctatgctgtccccctttgcggcggatttcatgcggcgtatgtgcttggttttctttttctggcgggaccccttaaaaggcaggtctttattggtcaggcgggcaaagatccgcttttctacataggaataaagtgtctgccggcagacgcgcaccccgaactccccatatatttccgggtggttttcaatttcatgcagggcggcggaggggctgtaatcgtaatccacgatcagctcctccagcttttcggcatagtccctatggtttccgatcttcaatcccggccctttagcttccagattggcttcgtacctcttttgtgatcgctccgggatgtattcggtcacctcgatgtaatccgcgttcatgtaggtgtatgtgcctctctttaactcacggcagacggtggccgcactcacatggagggccgcaccgatctggcgcatagtcgctccctctttccgcatttttgccattttgttccgatcatgggcggttaagtgcttatatcctttcatgggggcggcctctctttctctgtaatatgacaataggccggcgtggttctttctaccacgccggcctattctttgtccagcagccacagcacagggacctccagcacctccgcaatggccacggcctcgaagtccgtcacaatccttgccccgctctccatgcggctgatcacatcccgctccaccatgatcccccgcagttgcagcagtttgcatagctcagactgggaaagtctccttttctgcctggcctctcggatccggtccccgcacaaattccttttcccgttgatttcgtaaaacttcacccgcgcccctccgttgtggatatgacccacatttttcttgatattaacacaggccggcgtcaaaacccgtggtaatattcagcacaagaaaattataggccctttggcgcagggttattcattggggccgcggttccactcctatggcccgccgtcagcgggtgattttcataatgtcatttggggtgcagtccatcagcaggcacagcttttcaatggtttcagttgtgaccggcttcccctctcttaacttttgcagagtgctttgtgataggatgttttcctttctgatccggtatgtggtgatcccggcctctttcattttttcaaatgctccctggtaactgattgccactttcgccacctccctgtgcggatattgtatcacgctttatgcactctgtaaagtgcacaaagtacacaaatacaagctccttatttcgtgcatattgtcgcttgattatacaccctttaaggtctataataatactcgtaaggcaggggtgcccagccccttatgaaaggaagtgaggcaatggaaaccgggatgacaaatgcggagtttaacgcctttcttgaaaccttggcccagctcgtggaaagtaaggccaaaacggtacaagaggccgccgcgctaattcggcaggcgcaagcaaaataaaatggtgcgcggccctacctgacaagtaaaccgcgcaccaaatcccaaaagggtggccggtagccttacaccggctcacccccattttacaaaagtaaggcgaataaatcaagggggcttttcagatggctatttttgaagtgggcaaaaagtattacgacaccagcgcgtgtgaccataactgcattttcgttgtggagatcgtcaagcgcacggccaaaacggtgactttccgccggggtggacaggagcgccgggcgaagatccacacggacaacaacggggaatatattatcccggagcggtacagcatggctcccgtgttccgggccagccgtgagtatgtggaggccccggaggaggcggccaccgcctccccggaccccgtggccgcctatatcccccaggccgcgcagcccaccgatcacccaggcgtggtcatggttggccagcccgtcgtgggcaactggggcgccatgtgtcctatgggtatcggcgtgatcgtcggtttcacggagagggagggcacccgctggacccccgccgccaccatggcggtgatccgctgggacgatggccacacctccatggaggccctggaggacatacacccccgcgggtggcgttctcccagtggtagccccttgggcgtgttctttgcccgataaaataatatatgccgggccgggcggctacttcccggcagaaaggcaggaaattatgagatacggcgaacagcagcgggcctataatcaggcccggcaggccagcgaattggccggggccagggccgccgcccacgaaagggcgtttttagtagccaggggcgccacggatcggcgcgggcgtcccgcccggtgcctttggcaaatcgaaaatgacgccgttttcgacgccctggaggcggaataccaatcggacccggaggccgtcaaactgcaaaaggccgatatggccgccagggcggcgttgataaaagcagaaaaggccctggtggcctgggcgctctccattgttcccactggtattcgcgccacccttgcccccgccgccgaaacggaccacaccacccggaaaaagatcattgacttggccatgcggttggatgcctccaccgtgtcccaccgcgtcgtataaaatgcccccggcacctacacggtgctgggggttctcttactccgttttgtctttgttccagttcgtgatctgctccagggcctcccgcagtttatcaaatccaaacatagccgcataggccacgaacaggcccagggctaccgcgccggccaccatgtaccaggtgactacccagcccatgatctggaacaccgcaaagaacgccaccagggtgacggccatggccaccaccaccgccagaatattggtggggatcttgttccaggtgattttcttcaccacctgggtgatgatgttggtgattacggtcaggatcagtgccgccagcaggatggcagacaccgccaggggaatgtactgcatgatggtttccattgatatgtcctccttaaaattatttcacagccccgcccagggcgcacagcagcaggtccagggaggggaatgtgtcatagttggccagccaatagtccggggtgttgatcacgccggcggccaccagggcggccacgccctcctggggtgtgcccgtgcgcggctttgccttggtgatggtctgcgcggcctttttcagcaggatctccaggtattgtacctttccggcctccgctgcgtccgcccagtagtcctgggagttgatcacccccagggcctccagcttgtccgccgcggcctgtggggtgtcctggagcataagcacctggcccgcccggatcaggttccggttttggatggcgttaatctccgccagggtgtccacggtggttccgtaggtgctggcaatcttggaaagggtgtccccggatttcaccgtgtaaacggtagggccgcccgccgtggccgttcccccggaggtcccgcccagcttcttggcaatagcggcaaagtccgggcagataaacccgcggatgtatttcccgttgatggccatggtccgcttgcccacctttccaccgctcatgttgccctctgtcaccacaaaggtgcccgccgtgctgtttacctgggtcacaatgccgatatgatccccagctccggtacagtctccttttccggtgtcgtcccagtcatacacgcaggcaccgcctacatgacacacatgggcgtcattttccacccaaatgcctttgccctttgcgatctgcacgaacttctccacgccgcactcggtcccggtgtactctgcgatcccggcctttatgtacgccgcgctcaccgtggccgcacaatatgcgtctttcacctgcattttgtagccgcgggccaggggtttgtggctgttgtatatctccaggatctccaggtgtttggcgctccccttggtagcgcccacccatgtgttgataatatcggccactttctgccgcagttggttttctgtcattggtaaagcctccttaaatgcccacatccggcggctctgtccggtccgtgggcggttcctccggggcgggccggtatccgctcccgctcgttctggcggcctctgccgccttgtccttgttggtcttgatccatcccatgacaccgttttccaggccgcacacgccgaacacgcaggccgtcagggtggatggctccccgccggtatgccagaacacggccagtgcggccacagtataggccaccaggatcacgccctccagcaccagcaccttgtccatgacgcccattttcttggggtcgtcccttgcctttagcgccgttctctggccgtgtgtgtttcggtgcaggcgccgcgccgtagctccgcacaccaggaagcccagcacggtccccagtgtcatggaggcaatggccagaaacatggttttcatggttcgtcctccctcaaaaaatcgtgcttgatcagtcggtcatcatatacccggctgatattcgccaccgcatgggtggtccggttgttctggtaatccgggtttgctttgcagtatttttcgtactggtcgatttccgccaggatctccacaaattcctcttgtgtgtgcggaatgtcccgcagcagctcattgttgaattgcaggatcctggcccggtgcgcgtccgccgtccttgctccatccatttttatgtgtgtgtccaggatctcgcgggtttcgtccagcttgtcgatcacatccttgttgatggcccgccccacggcccgcgcaatggcggaccatggatccagcttgatgggcgctatctggatcagcgtcatagccgccagaacgatcccgccgccggccaggatttccgccgccgtcatgtggacacctccccaatggcctgggcgtagtcccggcgaaccgccgcgatctcctcctcatggtggagcgcatggagctgcgccagctccatggcctgggcctgtaaaatcacattcatccggtcgatgatgtcgcacagctccgccactagctttgtgttgtccatggccgtcaccccctcgctccgatcagggcggcaatgtgccgcagatcctccaccggggcctcgtagaacgcatgtccccacaggaaaaagtcctcatgctccgggcgtcggtacttctggcacacgggatcctcccacaccagatcccagcggccttgataccccgcgtcccgtttctccagcctgaatgtgatggccagcgtcagggcgccgcgttccagccccttcccgtcgtcgttcttggcgaaatgcaggtgggcatttctgcttgtgatagcgcacacggccgcgcccttatatatgatcaggccgtctacctcctccacctctgtcccatacgggatatttacatggcctgcaatccccgcctctttcatcctcttttttgttatgtacttactcacggtctacctccgtttatggatacagggaaagcccgcgtttcagcagcaccgtgcctcaccccgtgggctttcccttttccattgttccttactccttactaccgggcagcatacccagcagttcggtgtactcctcctcggtcagtttgctggcagcgaagaaaatgtccatcttgctttccagcccctcggtctggcctctctcgatcatgcgtttaagggtccgatacagcatcttttttcacctcctcttatgttaaaacgcttgcgcgtcggtgcttgaaatccccatttccagcagcgtcagccgcagttcctggtccacgttcatggcgtccacatccttggccgtgtcctggatccgtttcaccagatccccggcgtccgttttctccaggatcacgctctccgcgccctccagggcctcccggcccaggaggtggtacacggtcccgttatgggcaatccctgcggcctccgcctcctggcacagcacaaagcacccgtttccggcctgccgcacatagctgggggcctcaatcagcgccagctcggccccgtcttttacaatccgatacatgctttttcctcctcggttttcctgcccttgataaacagggcataatacaggcggcgcagtttcagcacccgcccatggtcgttgaattgctcatagtaggcgattgggccttttagccactccgccacctgctccacggtcttttccccggcgtccacctgctggcggaaatatcgcattttccgccgcgcacgcttcatgccgtccctgcacccgtgtgtgatgatccgcccactgggcaaaatctgaaacttggctttgcagaaacggaaaggcttgtccaggctgatcacatggcatttgttccggttgatcgtcagccccttttcctccgcccggaagatcatggcctccaggacctcctccgcccgctccacactctccaggatcgcgttgtaatcatccatatagtggcccatgccgtggagggatagctggcatttcatccagttgtccagataggatggcaaggccaccatttcctgctggctcggctccacgcccaggtacatgcccacctctcccggcaccgtggccaccatcagatccgccagcgcccgcaggtccgggtccaggatcaggcgccggtgtcgctcgtacagcagcgcatgtggggcggccgggaaaaagtggtgaaaatccgctagcatgatggcgccccgccgcccgtgccgccggtaatgccagcgcagttgttcctttaacctctggtaatggaagtgcaggccctttcccttctggctggctccgttgtcgtagatcgtgctggggcagtagagcggtgccagcacctccctggtgaaaaccttgtggatctggcggtccgtgatgtgcggggcgtcgatgatccgaaactttccccgctcccgcagaggaaaacggatcgtttttcccggcctccatttccgatccagaatcttgcgccggcgcttggccgtgccggaaaacaggtgcagctcaaagttgtgtgtggatcctttccagcgcacgccgttgccgcactttttcccgtatttgaacatgtttcgatagctgaaaacacccgccagtcctcccaggctgtcgctacgggcctgtctgtttcttctccgccgcgcttggcggcgtcggtatcgcgcctcccggcgctcctcgctggtcataatatttttattcgccctccgcatagttgtcttgttggtgcgcgttctctgcgcggccgccggcggctctgccgctttgtggccgcggcgtcccctttgcggggaaaactactttggcccgacacatgaaacggggatagcgcaataccccgccatgcaagcagcgtccgtgtaaggccgtcagtgggcagttttagggatttacacccagggcagtatttctccttttatacgggttcgggacgctcctggcgtccgctttcaacccattctataaaatccgggggccagcgcccttgaattgtccgcgttgttgttgttgggcgtgccgtccgtgttgacaaggcagaaattatcgttgttgccggcataggcggaacgggtccacgcattgacagccgccggagtgtcgccctgccgcacggcacttgttcagaaatacacccggttatgacctattatcgtttcttgtcgctctccatgatgttccgcagcagggtttcctcctggtcgatcagctctcccagctcttgggccatgcggtccagccgctccgcggcctccttgggcggcacgctcttgcccttgctgtctgtaaaagcgccctgcgggttgcagtacaggatttcataacagtgggtcaggcgcacatccagggcagacagggcggccagggcctccaggtggtgcgctttccgcagctccttcctttgcccgtcggacggaaagattttgtttgcctgctcagcgtggtccatggcctggccggccaggcgggcggtgtctgccgcgatcagccgggaatatcgggcggacagccgcgaaagaaaatctacggttttcacatagatctggttggcggtgttcacatattccgccttgctggtggtgcgcttctcttttaagactgacatgggaaacatcctttcgtccgccccgcagggcagggggttcctcaaagggggactggtccccctttgaagccgcgccgggcgtcagcccggttttggcgttttcgcaaaaacgcccgcggctttatcccgcccgcttccgcgggacgggattgaggccggatatgctgcggcgattagacggcaaagccgggggccagcgcccatgaaccgtccgcgtcggtgttgtcgggcgtgccgcccgtgttgacaaggcagaaataatcgttgccgccggcataggcggaacgggtccacgcattgacagccgattccgggttttcaaatcggttgtgtaccttgctgttccccgccttgtaatagtcatactgcttttgatagtttttctccgcgctgttggcgtaggtccggctgccgtggtattcaaactctgccagcagaaagagataatctgtggtgcccgtcacataactgacatggtcggcccctccaccagtattgtcagtaaactttctgacatccttcatcaccgcccgcaggtcggctgagatggccgccagcagggagttggacggcgggctggacggcgtgccgctgttgcccagcagagttttccgcatgtagctgtcattccatccgccggcatttgtgcgatatgtgttcatggagaaatacccggatccgctcacgctgctcccgtaacgtccgtcacacagtccaatcagtttgttcgagatctttccaatctggaaatgaattttattgtttccttcaataatgctgttgtggttgaatccaatgataaaggctgcaatggttatgttcttataaacggattcccccacgttcccgttgataacaatattccttgtatcgcccacatcccagtaattatctcccttcccagcgtccgaaaccgccttgattgtggcccagctgttggagtccagcgtggtgttgacggtggtcaccttgatggcctgggtggtggtcttggtcacatccccctccgtgtaggaaaccgtgatggtggtatttcccgcggccagggcgccggtgggggaataggtgtacccggtcaccgcgccgctgctcccgtcggtgtagtaggcggtcaccaccatgccggcggtgctgaactgctcaccggaaaagtagctggtgcggttggggggcgtggtgactgcgatccggtccagcaccttggccaccgtgatggcctgggtggtggtcttggtcacatccccctccgtgtaagaaacggtgatggtggtatcactcaatttcagggcgccagtgggggaataggtgtacccagtcgccgcacggctctggccgtccgtatagcgggccgtgacggccatacccgccgggctgaacacttccccgtacttgtaggcggtttttgtgggcgggttggagatctcaatgctggccagcacccgcaccgtcaccgccacgctggcggtctttttgatcccgccccgctgatagctcaccgtgatggccgtggtgtccttggagatggtggcaggggagaatgtgcaatcgtccgtcacattttcggtggtgtcatccgcaaaggtggcagttaccaccattcccgccgggtcaaatgcttctccgatgtaatagctctttttattgggctgggtggtgactgcgatcccctcggtgatcatcagatccacctcgtacagcagggtgccgttgacctccaccacctgggtggcagtctgttcgttcagggtggccgtcacggtccagtttcccacatttggcaattcaaattccgtggatcccgttccctccagggtggtttctccgtctgaacaggtcacagtggcgcccgtgcaggtggtcaccttgatggtggggctttgtacgcctatggcctctttcaagctctggagggtggcccgcatgtgctggccgctggcgtggtcgtagaatgggataaagtcctgcgtggacatttcctccgctgccgtcagcttgttggtgggctgctgataatcggtgcccggtgtggccgctcccacgctgtatttttcgccctcctcggtggtggtcttggtccctttcagcagtccctccaccttgatggtgtcctgcttgtctttcagggcgccgttgtgggcgttgggatccttgttgtgtttgtcgatcaggtcatccagcccggcctccagatccggctttagggtcccgttgaagtattccgccacatcctcggcggtcatccacgcctccgcggggtaggacacttccacctccacgccggcggtcacggtgatggaaacggggtagcggcgcacatccggggcggttccctccacataggcgctcacatactgcttttgctcccccagggacccataatagatcatggtttcggtcccgttctctaccttgccgaacacggcaaagccgccgatccagaaaccctcctgtaatccgccgttcaggtcgctgcggtactccaccagcatgttgacagcggcgccctccaccgttggcacggtgctggtgccgttggggcctgggtcaatgggggcggtcagcttccggacggcctccgcgctctccgccgtgcccttgtccatgaccacctttgtaatggtcagcttatcaccggccaccattttggccagcagattgttgccggcctctgtaatgacaaatccgtaaaacatggttgcctcctcttactccgccgccggtatggcggtctgtgtgatagtcccgaaaaccccgcccgctcggatcggggcctccatgccgtagtccatgggcgccgccggcagggcggtggacatatagccccgccccatggcgcccgtgatggtcagggccgccggatccatctgcgaaatggtgataatatcatccagccaggaggaaaggcgcttgacggaggccaggacccgccggaactcctccagctctcccggccctacctcgccgccgtcccccacataggcccggaaatggtgcggatcgccgtcgtactcgtaccactcctcgatatacccagtttcaaagatggtttcaatgatccggttgaccgccgccggggtgcccatctgcgtgtaaaacaacagggatccctcaatcagcgcccgcttggtcttgatcgaataattttcatcataggacggggtgcgcagctccacggccatataatccagcagccactccggcatggtggcaatggccgcataggtccgggcggcatcggaataggcacacagcttttccacctgccgccccaccgcgtaggcaatcgcctggacctccgcctggctggccaggttctccggcatgatgtcggtaaagcggctcccggaaagtttaatcatcctccagccctccataggtcacggtggcctccccctggagggcggacaccttggtggccgccacggcggtgtatgtgggggccgtcacggtcacccgcttggccccggcctccatgaccatggccaccagcttggaggggtttatgtcccgtccaatggcccgctgccaggtctgataatccgccaccgcctgggccaccgccgcctggatggtcacggccttggcgctgtcgctccggttgatgtaataggtcaggccgatggtataggggacctcctccggggccgatacattgaccagatccgtcataggccggatcgtcttgtcttgcagatagccctttagcccgttgatcatttccggcccaggctttgctccgtcggccatgatgaaaacaatatccaccgtgccggcctcctggtcgctggtggccaccacatccccaatggccgggctgtacgccttggcgtggtataggtagctgtcctctggtcccgccgtggaataggcgccgggggccagaaaaacccgctccgccaggtctgcgtcactctcgatctccgccccgccctccgtggttgcggtgttggccacgctggccacataggggacaggatccaccatggtggacagctccccggcggtcaggccgttgccggcgcttccggtttcggtgcaggtggccgccacctccaccgcggtgctgcccggcgggatctctgcgtattcgtccgtggcaaagtacacggacccggaggacgccaccctggtgccctgggggatggctgttgccgtttcccgctccgccgccagggtaaagcgcagggtacaggttgccgccgtggccggacttctggtgacgcccttaaaaagcgccaggttgtccaggtagtcggaatagctgtatttcaataggctttgcttgccctgccggtcaatgtactgcatggcctggtagatctgcgccgccgcggcgtacaggatcatgcggtggacgctggcccggtccagggacacggccacgccctgggcctgcgtcatatagtcctcataatcggccaccatttcgccccgcacatcctccaccgtcttattgtcaataaagctgatttccggtgtgttctcgattgctgacatgtcaggcacttgtgatcaccaccttgggataaaatacgccctcgccgccatgggtccattggacggactgcacccgcacctccgggataaattgggccgtctttttggtgatctccgccgtgtaaaggctcttggctacctccggcggcatgtccacaaaatccatattgatcccaaattcccgatccagcggcatggtgccctctctggtggagtacagcagggccagcttgcggtccagctccgccatagcgtcattggcaaaagtgaattgcagttgaaaatcaaaaggtgaaatattcatgcgtattcctccagcgtgatggacagggcggccttgaccagctccccgcggctgaatatggtggaccaggtttcgcttgatccggtcagccgaaacggatttttccccaccggcctgttgccgatgaccaaatattccgccgtccctgcttccaccatgccctccaccgcctccagcacggaccgggggcgcacccccaggccggcggacaggtatatggtcaggtttacagtctggaggccagggcctaaaaactccgcctttggctttgctcccatggcttcatggatggcccagcgcccggaggtttccctggtcatttcctggaggatcagggcggtttcgtcgctcacctcaaagacgattttccgccccagcgttccaatggtcacagcttatcctcctatcttcacatcagggcttccgcccgtcacggtcccgctcccgctgtgcgcggccagggtgtcacccatgcgggccgccggtttcccgttgatccgcaccgtcccgctcccagcgcccacggcgccctggctggatccacagcacccgtcccgctcggtggtaatgctccccaccgtagcggcggacaggccgttgatccgcaccgtccccgaacacgccccggagatctccccgctgaacggttccggggagtggggcggtacatgccccgtgtgttccccggcggtggttcccgccaccgcgtcggttattcttgccgcctgcggcatggctcccgcctcctttagttcaggtcgatggtggcgccgttgatggtcaccgctccgccggcctcaatgtggatggccccggcgcattggatggtcagggtgcttccgtcataccggatcacggcctcccccggcgtccggcccaggtccttgcggaacaggccctccgcaccctccgggggtttgtgattgccggaccaataccggcccaggaccagccctgcctcggtcccgttggataggtgcagcaccatgacgggatcccccacctttggcatgttgtactctgtgcagagcatgggcaggggggcggtcacgctgttgtccttgtcggggtagaccacccgcaccaggccggcggcgtagtcaatggatgaaaccttgcccaccctgaaaatttcatttgccatatcgtcctcctcagtccgccgtcagggcgttggccgccttgagcagcagggtgtccagccacgccagggaggtgtaggcggtggcccagtagtccggggagttgatcaccccggttttggtcagcacatccagcgccgcgtccaccgtcgtgatacttgtcccgcccaggttgactttgatccttgtggccatgttcaggattaggccgtccaggttcttcacgtctttgtaatgggccacccaatactccggggaggccatgacacccacggcggccagccgctcggtggcgtccttgatcacttcctctgtcatggcttccaccagggacagctccaggtccatggtgtagccgttcccgacatggtgtgtaatactgtcgatgtaatacttgccggaaaggcgccccaggcccaccacggtgacgcattgggaggccaccagggtggcgtttccggtaatggtcagggaaagggtggtgtggccgtggttggcgctgtccaccgccgcctggatctttctttctgcgtccgccaggttgtcggccttgccggattgtttcaggatcctggtgcccgtccccaccgtggccttgatctccgcctcggtgatcgggtccgtgtaggtgtatttcccgcctgtgtaggttccagccagggtctttttccagctccagctctcaatgtcgctttcccgtatcgttagcacagggtcctttttcttgtatgcctcccggtcaaataccacgattttttgggcatacactttcatagcgtagccgtaactttcgcacacctgcatgtaaaaatcacaatccgtctggcttgactgctcaatggattggatcgtgaacggcgtcccctccacatcccaggccagggcaattccggcccggctggctatctcttttccgatctcctggaccgtgactttctcccaggtctttgtccgctcggtttcccgaaaggctccgtccgccggaacggacacggcggaaatagtccccgtgatcggccaccctgcaaaatcgaagttgtccaggatgaaaaacccgcaggggagggcgcggttatcgtcctcccgctcccagttggaaagttttatggcggcctccagcgtgtcaccctccaggggcagccacgccaccgtccattggcggtcccggtcatggatcgaaatgtccaggctgtccgcctctccgcttgcgggatccgtgtatgtgatctccgtggtttggcccagcattttgcttttgactgccgcgccgttccaggtcagctccaccgccgcgctgcgtgttctcatggcgtcctccagatcggcaggttttccgccttgtcatcctccggcgggtccggtgtttgcaagatcgttcccgcctcaaatacgaaaatatccagcagggggaggttgttctgcataagccaacctgtatatgtttcgctcccatataccttgtgcgcgatagcgtcccaggcgtccccctgttgggtggtgtaggtttttgccatgtgcaggcctccttacgccggtgcaaactttttgcgccgctcctcggctttcatctgcttgtacatctttttgaactccgcaaagctcatgcgggcggcttccacagcctcctccttggtggtgttgccgtagaaatggaacacaggggaccacacgatccggttcccgtcgccgtcctccgggcccccgccgccctggggctttggcttgttccattcgtccagcagggccgccagcttggacagcggcatgacagcctccggttctccgccctcaccgatcatggccagtgtgggggccgtggcaatgccgccggcggccagggccggaatggtcgggatattaaagcccagggtttgcccgcctaccagcggcacccaatccgggatggtcaccgaaatgctgttgatcttctccagcacccagttgatggccgaaataaccccgttgataggcgcttttgccaggttcacgatcatgccgaacaggtttccgaagatgtttacgatattatcccaggcgccttcccagtttcctgtaaaaacattttttacaaattcaatgatatttgtgaaaatggcctttacattttcaacggccgcctgtatgctttgccaccatcctgtgataaaggcggacagcattgggaagttggcctggaacgcggccaccagattggaaatggtagttgtgacccaatttttaatattcccgaacacttgtgcaatttgagcgcctagttctgcggccttcgctatcacggcgtcccaattcttgtacagcaggacgccgatagccactaccgcggcgatggccgccacaacggctaggacaggcagattaagcgcggtcatggctcccgccagggtaaaggtgcccgttgcgctggcttcggttactaccttgtagacacccataacggcgttgtatgcagtcaccgccagcttatacgccttataagcggccaccgctgtcaatatgccggcggccagcgccaggatcagatccttgttttcggaaacccattttaccgccgtttctgctgccggtaggatgacccctgtcatgtagtccccgatcctgcctagggcttcttgcacgacgggcagggccgcctctgccagctctctgacatacggcaggatattggtgcccagctccgtcaaaaagtttgcgcccaggtttttgatcatctgaatgtcataggccagcgtgtcggtttgccgctcaaaggcggtgtttgccgcgcccgtggcctcgtacatttctgctgtcttgctggtcaggttttccgcctgggttcccgccatggccagcacggcggtttgcgcctctacggaggagaacagcccggcaaacgccagttcgttcccgcccacggatttttttagggcctccagcgccccttgcaggccctcgctctccagcagggcttgcccgctttcatagcccatgctttgcagggccgcgctcatgttcttggacggcgataggaagccctgcatagtagcctttagctgggtcactacttccgcggtggatccggttacgcctgtcagggtggccatggcgccgaaaagctgttcctgttccacgcccaatgtgctggccagcggtatcactttccccatggccgccgccagctccgggaaagtggtttgtcccagtcgaaccgtggcaaaggatagatccgccgccttttgcacggcctccgccgatgtatcgccgtagccctttgtgactgcggacagcagattgatactgtccgttgtggtggcgtttcctgccgccgccgattttgcggcggtttccagtatactggccgcgtccgcgctgtcaccaaatgcggataccacctgatacatgccgtcggtcagatctgccgtggctacgcccgtccggttcgatacctccatgatctggctcccgatttccgaagtgcgtgccgccacctctgcctctgttcctgtcagcagggttgcgacattggccagctgggcttcataatccgacgcggcctttaccgcggccacccctatggttcccacggcggcggcaccagccgccgccgctccggcgatcatttttcctgcgttctttgcggtttttcccagcgcgtcgatgttcttggcggcggtattgcaggcggctttcaggctgctgtcggtctttcccgcgattttcagcagcatttcatagctcttactttttgccattcctgcgcacctcctccgaaagttcgtttaccgtgtccgctaaatcgttcagatcatccacagacagggccagcagatagtccagccctgtccgcagatggacggacattccgacgcaggctttccgaatgacggcgggtgtcagttgttcccatccccgccgtaaagaaaacccacaattttgcttttcagtgcgatggcgtccctggccggaagcctctggaaaaattccagcggttttccggtcaccctggccgccagcagttcacagtaacccatttccatttcgatggtggcagggttcagcccaggggatttcttggccatgatcttcccaatgttctccagcgttcccgccgtcacattctccagcccggacagatccagctcggtatattcctggccctcaaacggatagggccggcggaatttcaggatcaggctctcctcctgctcctccgcctccagggcggcgttgttcttgatttcatccatttagcacatctccttgtattcggccagcagatccacgccgttgaccttgtatgtggggttcatcttgtccagctccacgacgctttccccgttcacctcaatcaggatgtaaagaatgttcagggtcacgccgctgtccatggtgctggcccgtttcagcttgccgccggtcagcttggccgcccggccccggaccaccacccggatggatttgggtacgatgttgccggcgctgtcgatctcctgggcggcgccccggatcgtcagctgcacggccctggtctggtccatcatgttggtggcctctttgtccagggtgcggaacgggatttccagctgcatattgccgaaatggccgatggtgggatcgtcgatctcacccaggatcccggcgccgctcaccgtttcgctggtggcctcaaagtccggcagggtcaattcatcccccacgcccagcagcttttccccctcgttgtacacattgtagttgtttatcttggtcgggatatttttgctcatggtttactcgcctcctccggtcagcgcggcctccagggccgcggtgtcgtactcgcggatgttcacgatcttctccgcggggatgtaaggcgccaggtaggtgtgggtggtcagcttcccgtccagcaggtcggtgatcgggttttcctccgcatggaactccagccgatacccggcgcagtagtcgcgggccacatacccgttgccaatgatgttctggctgtccacgatggactggatcagccgcttgttgcccggcttgtctaccttctggaagtaggtcaggatgaagttgtttccatcccagtcaaaaaaacgccgcaccgccagccagcggtccttcggatccgtggtggaggggtaggccgccgtgttgttgccccacagcttgaagccgttggcgttgatggctgtgatcacgccctggccgttcaggaggttggcctgctcctggtccagcgccacctcggtgccgtcatccagcacagtggcggtgattttcaggtccttattggaggggctttcatagggcacatccccgttggccgcgtcggtggccgccgtttccgccgccgccatggcggacaggcaatagatcttttcacccaccgcccccttgggccagaataccgccgcgtggttggagcttgcgcccagcttttccttggcggtctttaccgcggtgtaaaccgtggcgcccgtgctgtctgccgcaatgtccagataggtgttgcagtcgaaatttccgttgatctttccggtctttgcctggagggccgcggccaccacgggatcgtgggaccatccgggggccagcagcaggccaggggtcaggcccagcttgggataaatctggcgcaccagctccaggcccgtttcctttccggtcccggtgtccacgccgcccacaacatcttccttggtcacgcctgcggggttcaggctggtggaggacaccatcaggctttccgcctcctttgcggtttcagagatcagcgtgatcaccacattcccgtcatcgtcgtgggccgctgtgtagtccacatccgcctccagcggggaactgtctttcttgaccaccatcgtgtggaggaggacatagggctttttataaacggcctgcccgttggtcacggcgcagctctcctccccgttgttcttggtgtgcttggaattgccgggatccagcacattcaccagaacaatgggggcgttattgaacacccggaaattggcgtcaatgctctggcaaagagtgaagtttttgaaatcgtcggaatagcccacagcggcctggcactccgcaaaactgtaacacagcttcagggtgttggccgctttggtcggatcgtccgccaggtgaacgggcgccgtgccgaaaatcacctggagggcggcgctgcttcggatcggcgtggtcaggctcgtggcctgttcctggttgtacacgccatgctgataggttgccatgttgctttacctcctgttagtttcgtttctgtgcctttcggtacagggcataaatggggccggttttctcccgcagctggcgcatggcctccggcagctggtccagcggtacggtcaggccgcccagcaccggggtttgcttttgtgccgccgccagggcctccggtatgccgccctggtaggatgtgaattgcttggccactccggggatcgtggggccgcagtacaccagcgtgccggcctccgccgccggtttggtctgtttctttgctgtcatgcttctggcacctccttgtggaccgccggcgcctggatccgcagggacatggccgtgaaatagtacgggtgtgtgtcctcctcctgggtggtccattccatagggtaaagaacctcccagcggttgccgatcacggcgcaggcggaatagtgatgataaattttgttgatgatgtgcagggcgtcccggtagccctggcgccccggatcggggtcgtagacacatgccaccagcaccgcgtcaatgatctgcgggtcatcgtcgctttcggtctttccgccccggaggcgcaccaccacatacggctccggcggtgctttcttgtcctgggcttcatcgtcgctttcccggatcggcacatcctgggggtagatctggatctcccgctcgacgcccagggaacttttcagcctctcatgggcgaaaagctcctttaggtccgccaccatagcgtcctgcaaaaattcttgggtcacatgcttgcgcctccttgactttttaccgtttctttcgtataattacggttgtgttaatgttcataaaagcgtggtaataatcagtaaaaaggagaaacaaaaatgaaaaggaaaagaacgcttgcactcttgctttctctcgctctttcggtttccctctgcgcctgtacagtcacgtcgtcagaggaggggggcggtagatcttccgtggagactggatcacctgctcccgtagaaacgcctgcccccacgccctccaccatttcctttgaacaggaattttccagcggcaactacaccgccggtattgatttccccgccgggaaatatgacatcgtggcggtcagcggcggtgggaatgtcagttccagtaacgcctttgacggcgggatcaacgcagtcatgggaacagaggacaaaaacgaactcatggatatgtacgaacaggagtacagcaacattgacctgcccgacggcaccacgctttccatttccggtgtaactgtccgcctcacctgcgacgcggccagcggcgctccgctcacgccccgcaatcaggtgatcaccgagacggtggatctcggaaacgggaactttgttgccggagaggattttcccgccggagtttacaacattgtggcggtcagcggcgccggtaatgtgtcttccgataacatgttcaacggcggcctcaatgccatgatgggcacagaggaggaaaatcagatcatggatatgtacgaacaggaatataaaaatattgacctgcccgatggtaccacgctcaccatttccggtgtccagatccagcttgtccccagcgtttgagcgtttggcttttaccttgcggccccctacatgggggccgcttttttatgccgctctcccgaaaccgtccagcacccgctccacctctcgctggatgtgcttttgcaggatagaataataatcctgggtggcctcctcgtaggtcttgccatacagcatgggcaccgccggggccatgagctttcttatcttggtcatatctgctttggggccatatttttcctcgcgttttgctcggcctcttgtgtagaactcacccggcacacgctgtacaatggccgtgtgtccgctctcgaatgtagcaacaaatgcttttggaccccttttttctcccagcccaacaaaactgctttcgttcagcactttcagcatggccgcggtggtttcggtgttcctcctggtcatgtaagccatgacctccaccatgccgcccatggagatcagggtggcctctgtgctggttccggtggcccgctccaggtacatgccgccctgtttcctgtcggtcaggatcttcttgtcgctgattgcatagcgtttcctggtccgttgcccgattttccgtttcatttcattggccgttgcgttgatggcgctggccagcacgccgggggctttcagttggttgggcagggtgttcagctggcgtatgattttttggatttccgcttgttcgtcaatctgtatcacgctttcgctcacgatctcaccgcctccagcgtgatggccagcataccggcctcctcggtgcaatcggccacccggaacaggcgcccgtcaaaatcaagctgtttcccatgggccgggcgggggccgtattcctccttggccacatagatcagccggcgggccttgtaggtcccatccacctggatccccatttttgacttgtcccgctccagcagctcgttttcatccaccaccacggtcatgggctttccgtctatggtgtgggtgtccgcgaactcctggccattcagaaatgcggcggaaatgtcagccgccaccaggtccttgaagccaggggcgcccatcagcgggcgccccctgtttcatttgcgggggcctgaacgggggccgctgcgatcagctccgcccgttccttgttgttctttgcgccggaaatatccacgcccagctggtcggccagcttttccagatcggcctttctcatggtggccagctggtcagggtccaggtgcctctccaccattccctcctcctggccgttttcctgggcctcctggcccccgttccggttctggctatcctgggacccgtccgcttgtccggcgccctcctgggcctcctgtcggctttcctcggcctcctgaccatcccaggccgcgctcttggcgttcagccatgcggtgaccatcttctggtcgttggcggggagggtgtcccctttgtcgtacatcctccccaggtaaagcacggggcgcttggcgatcagctttttcatgcctcccgccccccttatgtccgctcggtggctttcagcgttccgccggtagccacggtaatgtcgtacacctttccgtcctcacctttcagggccaggctgttgtggaccgccggggcgccgtccgggttcccgatattcaccagcacggtggcgtcgctggcctccgccgttgcggctgcgtagccggctgggacattgcccttttcagtggcggtgatttcgtccgccgtggcgtcataatacaccggggtgcccatggtgattttctcggaggctttcttgtccatgatgtacacgccggtgacatgcagggcgccggttgcgccctccgcaatgtcattcccggccacgccgatccgatttcccaggctcaccacctggccgttggtcacggcctcggcggcggtgtagtccagggtttcgcctctctgccagtatcttgcgttcatttctctgtacctccttactcggcaatagctacgccgttattgcggacaatgccccggtagtccatgacggtgataccccagtccagccaaatgtcccacacaaagcccaggtaaccggccttttcgctccggcggaaactgggggtttccacgccgttcaggtagtccacctgtacgctcttggccgtggtcttatcgcccacgatgtaccagggcaccgcgctggatccggccagggcgttgatcgcgccctcctccaccacctggagctgggtccggtacttgtaaagcgcgtttgcggtgtggctgccaatgccctccacatccacctgtgcggtttcaagcagctgggacataaggaaaccgtaccccacgggcaccaggatgtacttgggctgtaccataatgctttccccgaaaggatccgtctggcgcagtagcttcatcatcattttctggacgctctcaatggtgggggcggtgccggtggcgatcaggttcttgtgtgcgtcggcttcaaacagggtcacaccgtcatatacggcggggttcttcacgatgacctcatacacctgcttgttgatcttccgctttgccacgcgggcgtactggcccggcatttcggacaaaaagccaatatcatcattgatgaacgcctcgcgggtcatggtgaactgggtcccgtaggtgtccagcttgcgcagggggttcatgctggtgtccagggtgctgtgcttcagctctccgccctcggtcaccttgtcgaactggccgccgccgatggtgtattcatgggccttgctgggcttgaagtccggcaggctgcccttgctggtccacaggtcataggtggtgggcacaagctggtactggtgtacaatggatttctggatagcctgatccagaatagcggggaaagaggccgtggtggaaaggaactggcgcaccgccatgtcccacagttcgttcttgcccatgcgcagcagggaggtggtggacccctcgccgctccgggccatgcactcgatcatgagatcccgcacagacatgccgcgcaggctgtccgcttctctggccggattgctcacaggcacaccggcacgcagcaacagggcgtccaccgccgcgttgcggaactcattgccctggccgtcatcggtccgggtgcccacggggccgttgttggcgatcataaactccaccgccgcctggcgcacctggtccatggtctggccgccgcggatgtactccgccgggtccatgcccacctgccggcacagggccacaatgtcgctgttgcgctggcgttccgcctgcaccgccgcctggcgggccgcgtcatcgtttccgccctcgccctccgcgccgcctggatttcctgcgccgcggttgccctccgcaggaggttctccgccgccctggttcccgtcttggcctcccgcgttccgggcagcgtcaatctttccctggagctggtcaaactccgtctgctcctcgcgggtcaggccccggccctctttccgggcgccgtccacaatcgcctgctgtctggcgatcatttcttgaatggtcattgctctttacctcctaaaagtattttgattgatttggatctgccgctcgtatgcggacaggtccggtgtgtctgtgctttcgctggatcggcccacgcccacggtggcgtccgccggcacggaaacaacggaaatctccaggggcgtccaccgtctggcgatctggcaggggccggtgaagcgtccatctgccgatgtggccccggcccgcacctcctcccagctgtccacgctgtaacgcaccgatgtggttttcagggtcccgctctgcaccttgctgaaaaccttttccgcgtctgcgtcggtgtcaaattccacctctgccatgccgcggttgttttccagccaggcgcggatcacgcgccccaccaccttgtccacatcatggttgaaaagcaggacccccacgctgttcagccgccccaggtccacggcgccctctgcatggtccaggatctccatgccaaaatagcggcggtatggcgcttcactggaaaagctaattgtcctccggcggctgtcctgcccctcctcctgtcgggccagaatttgccccatgctcctggttccctggttcttgtccctgggttccggtgttctgctgtgctgctgttccttggccataaattacacctcccatctcaatgccggctttacggccatatttcaggacctcggccatttcgtccacggcctctttccagtccttaccctgttcggctgcgacatcctggaatgtcttttggcccgttgccagggcggttttggtggcggtggtttccttggccgggtcgatccattttttcggtgcctgcacccatttgtgcgccaggtaatccgcctttttatcccaaaatccgggcgggttgatcagcccggcgagataacaggaaatgacaaaagtttcgtagatctcgctcatgatctcggacagcagctcgatctccgccgcgaatgtggcttcatcctcattcgctccctgccgtgcgctggaataattgctttccgacatgtcccggctggtggcctcgtagctcatgccctgtccggcgccgatcaagcgccattgcattttcaggaattgggaggcgtccgatcccgcgcttttcggctccacggtttcgatactgtcccccacattcatttccttgatcatgcctggggtcaggctcttgccctcgtaggtcacccggtccccgccagccaccacgccgccgcggccaaatccgcccgtaggggttgcccgcttaatgaacacggccaggcaggccgcgatccgctccttgacggaaacggcggtgataaattcgtttgtgtcccgtacccgcgtaatggtgggggacaggtccgaaacctcacgcagctggctggggcggtgcttggtccagtacgggatcacatgcttggcctcgatgtacaccggggtggtcagcttccagccctccacatcgtactgctggatgaaatagcccaccgcccggcgggccgggtcgtactcgatcccacccaccacggtgttgcccttgtgcctggggatggaggcggtggtgtccagttcgtccacctcgatcatttggagcttgaacggcaccaggccgcccctcgtgtatcgcttgatgaacaggatcccgccgtccacctgcttccgcgttacggccatgcgcatgatctgggtgaaagactgggacgcggttatgtcgcagttttccttgcggcaccattgcttccacagcttgtccagctggtcgtttagcagctcgctttccgtctttgcctggagcttatagcctttcccgatcacattccgccgaaaagcgtggatcacggactgggcaatgtcgctgttgcgttccaggtcgcgggcgcgggcgcggatcacatcccggctgtaacggtctgttaattccgcgctttcgttgaaaacccgccacccggcatttaggcgcccatggctggccgcgtcatatccccgcagctcctccagggcttgccgccatgcctcccgccggtagcccctttccggcgaaattgcggtgatgatgttgtccaaaaatcccatgcggcacggtcacctcccgtcaaagtaggccacaaaggtccgatccagcaggtgggagggggtccccgccgccacctgggcctccagatcatcccgcatggctttcagcatggacaggtccgcccgcgtcagggaccggctgccgatcttgtaggactggccgcccaccagcaccgccgcaatggccttattgacctgctccagcagttccgccggcttcatttgtgtatttcccatttcgtcctcccgtttttatacccagctctcattttgccggatccagctttcctccggggtcggtgcaggctccggctttggcttcttgggcttctccggctcctggctttgcaggtatagggaccggacgccctgcatgtctgccgccgccgcggcgtacacctcgcagtccagatagtggttgtccgcgtgggtggttttcggcacccacttctgcaccacttttccgttggcccgctcggtcactttatgctctgcggtgacctgctccgcatattccagatcgcagtccttgtagaccatccaggatccgcttccgtttggcttcctcatgcgggcggcgatcatgtccttgtacttcccgccgtccaccagcaccaggtccatgccgtaggcattgctgccggccttgttgacttttgacaggcgatagtgggacagcatggtgggtacgcccttgcacggcagcacccagtccgcatttagggcacagaactcgtaaacctcctcggtctggtcgccgctgtccatcagggccagcgacaccaaaagcctttgcccgtccgggtgtataaactcggtgttcatgatctgcgccacctcgttcatggatagcgcctggccgtgggcaatgttctggctggtcatgtaatcgccccaggcccggatcgtccagtacaggcaattttcctgcacatctatgccggcggtgatcagcttcgcccacttcggcagggcgtatgcctccacctcggtctgccgctccagcaccagctccgcattggtccgcagtttggtgtcctcccatggctccgccagccagctgttgacaaagttttgcagcagctccgggtcatccttacaccgcaggaactccttggcaatctctgaaaaccgcgtgaaaggggagtacagggtgttcagccaataggccacgccggagggcctggcggcggtctgccggaccgtctgccacctgccggcggccagcatcttccccttgtcctggtcagtgatcacggccccgcaggcttggcagacataggttgccatttccgcccgctcggcgctgtccggcacatcgtccttgctcggccatttcagctgtgcaaatacaaattcgatgtactccccgcaatgggggcatggcacaaagtaatgcttttccgcttccgcctcctccttggctttccagatatggccggatttcagcgtgggggtggaggccataaatatcttgcggtttgtggtgtaggtcttggtgcgctcaatggccagggaaaccggatccgcctcttttttggaggcgcccggaaatttgtccacttcgtcaagaaacagataccggatcggggtggaggacagggaggccgggctgtttgcccccgaaaggaaaacaaacatggtttcaaatttcagctttagtttttggctttccgcctcccggtacttggccgccagcggtttgcattgccggatcatcggctccagcttcgcctccaccgtccgctccgccagtttgtcggaggggtagacgatcatggccggcgccgggtcctggtcaaccgcgctggccagcatgttctccagggccgtggtgcctcccacctgggtgggtttcacaaatacgatccgctccacatcctcgttggaaaaggcgtccatgatttccgccagatacggggtcacgctgttgcggaatggtcccggtatggcgttggtgtcaggcaggacccgccatttctccgcccatttggaaaccggcaggcgttccgctggccgcagggacaggagcgcccggtggatccacggcggcaccgtgtacggctttaccctgtacggcctcatggctccgcctcctccggtccgatctccgccgcgtcaacgaatacggccagcatgtcctccagctccttgcgcattgccttttccatagccctggccgtttgtgggtctgcatatccggctatggatttcacagtgcggggtggaatgttcatggcgaatttcttaaacatggccatgaagtccgccagatccctggtggcctcctcggccttgatgtattttccctcggcaatggcggttttcagcttgtggagctggccctggctttctttcagctccacctccgcctccagcttccgcaggttcagctccgcggtggagctggccgccgccgtttcctgggccttttgctcgatgtgggcaatataacgctggatcgtttcgcaggttttatattttcgggcgccgccgccgggcggcacctcggtttccagcacgccgtcctgggtgagctgctggatccgccgggtggttttccccagcagcttggccaccgccgtggtgctggcccactccgggactgtattcagggccgtcggtgctttcgccgccttactggccgcccctgctttggcctttccggccccttttttctccgccaccggctgcacctccttttgtgccgctggcccggttcgccccgccctgccggatttcgctttttcggcgtgggcgatttcgcgttttcttcctcccctttccgcctgataccccctttagggggtatggttttcccgctttttgaaaaagcgtaacgaaacacccctgaaaatttttgattttttgtggaaaataatcggacttcacttgccccgcaaagatttatttttcggaaaggacccgaacaggggagggggtggcaaattcacaagggaggccctgggccgcccctcggcatgagcggcccagggcaaagggtgtttgggccggcccgccgcgctcgtgtacaatgcggcggggcagggtgaaaggagaaaagcccctgcggttctgctccccggcccatggtgtggaaacagaaaggccgccaggttctcacgccctggcggcctttctctatttggctggggctttgctcttgcccctgtcgttttccacgataccagaataccacaggtgaatgtcctgttgtgtcctgtcttttcaagatggcctatttttttctgtgcatatctccggtgcctgcctttgctcaaactcttgtactaacttctgcgcccgcgcattggataggataatatccagggcggcgttgtagtagacatttacccttgacctgctcatgtggacctctttgcagatccgttcccatttcttgcaatctatatgccgcagctccaccacagtgcgctccatgctgttctctggcaacaggtcaatgagatccattaccatggtaacagctcggcccatggctatccgctgggcctctatgcgctcctcaacctctgacaagcgaaagacaacggacacggccccctcgctttctgccgcagattgggaggccggcatggtcatgtatgccgatccgggcgccggtgcctttagctctcgcgccagtacatcgtgccgccgctccagtatgcgccgccgttcccgcgccatgtggtactgctgtaaatattcttttacggcttcgcgggtggccccgcccgttgcctgctgcttcatgttcacacctcggttatgtcaattccgcgccgctctttcatcagctttcgcttaatcagatattcccgcgtccttgtgggcttgctttttacatcctccaccaccagccgcccgtcccgctccctgtatgtaaaatctgcccggtatcggatggcccgtactctccgcccctcctggtctgtatatgcctcttgcaaagtaaaatccacctggaggcgcagatcatggatttctccggcttgctgccgtagggtcaggtggtcatatctccgggcctctttttgactgtcaaagcggagaacggccccggaggcggtgacccgctcggtgggggtgttgcgatatttcgccgccctgtccgtattctgcacagcggcggcgggaggcgcaggcccccgcctcttctgctgcttcatgtacttttccatggcctgctgctgatatttgggcggcaggtccgaaaggttgatggccatttattcgtcctccaggtccgggacctctacatatttccacgacataggcggacggtttagcccgaactctgccagcgggctgggggtgtcgtattcctccgcctctcccacaatccagccatacagcgattttccgccgccgtcctccgcaccagcggaatggcctttttcagctcattcaccgcataggacaggcgccagcgggcgcagatatatgcgtcatgctctgccagcgcgcagccctcacattgctgtggccttttctgctcggtcacttctggccacctcccggcaaaggaataaaccggcatttatccacggcaaactccgccacatatccgatgtccgtacatgccagcataatgtccgccatgagatcgtccgcgtcctcctgtccgcgtccgtccctgttcatgttccgcaggttccgcgccatgatctggccaaactcgtgcaaattttccgacgcggccagccaccgctctttctccacggtgtagccgatttcgatttcgcccacgggtcacacctgcctttcaaagcgccccatgtagtgggcggcccattccgttgttgcgtcctcccggtcatcccacggtgaggcagagggcgggagatccgggaaatgcgcccgcaggttgtccttgtagaaaaccgggatttcgttctccgcgcagaactgcgtgatctggtccacccactcccgccgcggtgtcaccttgtccgcccggttcccggtttcggcccccaggatcacccactggggcaggccctccgccgcgctcatgtccaccggccccagcagcggctccatggaccaaaagctgttaattgccacgccctgcatggtgtacatggccgccgcgtcctcattggccaccgtggacccataccagaaattattttcatgcgggagtaagcccatgtagtccagttgcaggtatctggccgggtttttcgtcaggaacaaatagcggtgctgcggtgcgcggcggcaggcgtccaggacctccgcgatccaggaggtcggcacccagcgcccgaacagatccgccatgctgcacacaaaaatcgtctgcggctccgcctggcgttccggctggttcaggcggtatctgtgcatggtgggttcaaatccgtatgggtatggcgtggccttgatcttctcctccagcacatggaggccatcagccagcggatcaggatccgcacacccggcgtcaaagcggtgggcggttcgtctggcgtagcagtatgggcacccatggcggcacccggttacagggttccagctcatggtggcccagtcaattttcgtcttgttcatgtcgcttcccctttcaaagtttttccacgattttccccagccaccgctcggcggcctccacgcagctgtcaaacaggaggccgtccgggtgttcttcgatgtaatggcacacgccgccgtctttttcgtagtcgcagcactcgcaaaattcagcggtgcataagatcctggccagctcctcgcgggaggccgccccgatcatgtcctccatggtggccaggacctccggtgcgttttcttttctccagtgtttgcaggctttccccatgtagtccagcaggcacccgccggcgccttggcacctatcgcatattttcatttctctggcctcccagcataatcatttttctcttaccagcttgtcaattatgcggccctgctccttgtagccgcacatggctgccagcttttccaggttataggccgtctgtgcggtcaccaggacgctgatccggcgcatatttttttcttttgctcatacggtcaccgccctttccagttcctccatggtgttgatctccacccctgcacaccactccggcagattagcccgcaccagggccgtggcaaagggaggcggcaccgcattgccgcaccgggccacctgcttgcttttcccgtaggtctggccggtgtagtcccgctcgatcttgtaatcatccgggaaaccgttggcccggtacagttcccgcggcgtcagcatacgcaggccaatgtccgccatgaaataccaggcaccgccgatctggaacaggatcacatcctccggccccaggtcatagccgcaatatgtattcagcagctcccggatctccggccagtgtcggagatccgcccccggctccgctctggtgatctgcgtggtgaccacaccatggtggcctccgccggcggtgatagtctgcaccggctccgtggccggtcctcccaggtttgtgcctttcatcttgaccaggtgggcagttgtcagcccctcccggtcctttgccgttaccgtgtggagcgggtcctgtatgttctgtccgtgctggtcgctcccgtagtatttgaccaggctggccgccgttaagccgtagcggttggcggcgtcaatggtcataatcggcccggtgatctcctggcctctcacatgctcggactgttccgtgtggtactggatcagggaggcccccaaaaacatttgcccgcctccgccgccggtccgcgccgtgtctattggctcattgactgggtggcccgtggagttagtggtgttggtcactgtccagggcaccatggccggacttaccaccccatacccatgctttgctgtaatggtctggagcgggtcctcaatctcctgtccccggaactctccagcatggttgaccaccaccaaaaacgggtttgcagacttgaccacgaacttgtccacgcccctggccacccggcgcatggtgttgggccggagtggccgctgggcggaaaggccgtatttctcccggatttcctcccgtgtgtcaaaaatggagggacagggcaggctccagtctatgatctccgccgcactccgccagggcagtttcttcccggccagtacctcctggctgtccgctggcgcgtgggtaggctccggccatacaatgggccgcccgtcacagcgggcaatcaggaaaaatcgctttctggttgtcggcgccccatagtcagccgccaccagctcccgccattccaccgcatagcccaggccctccagttggtcaataaagcgccggaatgtttgcccggcctttgcctttaccgggtgcccacggcggaccggcccccaggtctggaactcctccacattctccaggatgaccacgcggggccggactgtcccagcccaccgcaggacgatccaggccagcccccggatgttcttgtccacgggcttcccgcccttggccttgctgaaatgcttgcagtcaggggaggcccacagtaaacccaccaggcttcctcctgtgacttcgagcgggtccacatcccacacgctcgcctgatagtggacggtgtgcgggtggttggtcttgtgcatgaggatggcgtccgggtcatggttgatcgctatgtccaccacccggcccgtggccagttcaattcccgtggaagctccaccgccgccggcgaaactgtccacgatcttttcctcccacatgctgatctgcgccttgctcattttcctgccgcctctctcatgccgtccacatacctggtggccgcctgctccgcctcacagtatgggcatttcccattcatccacccagcgcggaacatgccgccacattcccggcatgtcacggcgtcgtgttctcccgtggccagttgcaccataaagccccgcaggttcatggcccaggttatatatacctccttggcgtagattgccgttgccaggttgtccgccatgtccacagcctcccagcgcgggattaggatcgcgtgattttcccgcgtccgtttccccggctctgcccatccggccctttttgctccttggtattccagcgctttggcgctggccgctttgtatgcttctgcaaagtctttcactttgttctccctcctgtcatttccagatacagggcgcagtctttcccaatcctctggcagtacgcccattccaccatggcgccccggctctcctggtagtccgggaggaacacggccaggtccgacgcctccagcatggccagcgcgatccgcatataatccccgtcggtcagaccgtccggcagggtggcagggttcaggactacatggcccgccgcctccagggtcttggctgcctcccggaacttggcccgataacgccgatccccggcaatctttcccgctatgtaaattttcattgtctgcgcctcctattcgttgaaaacctcgaaatattcctggtatgggtagccgctaatctcatgccacccgctccgggtggtggatccgtcatcgaacttgtacagcacggcgcccttgctggcctttggctccttgcgccaggaggaggcagacacgggggtgtatgtaataacgggcttgtccatgtttttggtcttgctgtaccgctttccccgtttccccagctccctgtatttctccatggtggatcggctttctttgaccaggtaatgcgccagcttctcatggttgcctctgcggtccaggggtttgaaactgatacccccgccgccccttgggacgctctcccatgcctcggtgatgatctccgggtccatgcgcgttattaccacatgaatgtgcgggtttgtcatccgcttggtttcgatgaccaccacggccttgtatttgatcctgcgctttttgcagatcttccgcaggttggacagaaaggcggccttgtctgccagtatctccgggaaagtggtgtccttggcatagtagtgcaggacggcgtggagatcccggtggtcaaagttggcgtttaggtcccagcgcaggtgttcctccgccaccctctcgttgaccttggcctgcttctccgatgtggtcccatggttggggcctctctggaccccctttgtgtggatccggtatgactgcattttcctgtgttcgatggtgcggccagcctttacccgcctatggacataggccatgctgtactcctcctttgggcctgctggtcactttactaatagctcttaccggagctatacggggccgcggccccgttgaattttgcggcttgcaggccgtccgggagtatgctataatgcaactatccaggacggcctccgcgccgcctcgtatctgtccacctgcgccgtgttgtcagcaccgggcgcaggtggttttctttttatgataggtagtcattggccagctccagcagctccgccgcgtgttcctggtccacaatcttgacctttccgggccgtttcggatcttcctcaatggcccaggtcacttttttgccatgatttcccattcacttaacttggcggccatttccctggtgtaccgctcccggtcctttttccatgccatgaactcctggaactcctcggctctcatatttacagttacttccattactctgatacctccagccccagccaccacgcggggctgtttctttttccctcgtgtgggcataccttggggcagttctccatggggcagttgtcgcagaaaatccggtgaaaatcgtcatcccatggcgcgtccaggcagggaagggaggccaaaaaagaggccagggcctccggggaggcggtaatccggtcaaaattcgtctttcccatcgtcacgcctcctctttgtgcaggtccacgccctccaggtcgttccacacggcccgctcccattccttggcccagcttgacctggcttttcttactgcgtccatggccaccacctcggtgtccccacgccacagcaggcggtccccgtcgatcacggcggcggctccatgttccaccatttcccgctccataacccccaggtcaaggaggcttaccccgtagcaggccccgccgccgtccggctggaaaatctggtagccctgcatgatcaccgtggccatggtcaccgcgtcggtgcgctccccggtcctccagtgttcaatttcatccgccgccacctccggcatgattagctgcggctctccatcctttacgatggacacgggttccgtgtccggtatcattcccatgtgttccacgatggtggccagcaccttgcgtgggatggccgcccgcttgcattggatataccattgttctgtgtaaatcgtcatgcaatcgccctctgcggccaccgcatacccggcggatttataggcccgcttgatacagcgcaccaggccgctttcgttgatcggcatttcgccgcctcctttatttatgtaatgtaggcatgggggccgcctgctccccttgtgcggcccacacttgcgcgtccaggatttccacccagttgcacccccacacctccgcagcgttcaggatcgccgccaggtttgaacagtgtgggaccaccacggacccgtgggccgggtgtgttactctggccctgccggggacgctccagcggtggatccgtgcccgcctggctgccgccgcgcgtgtgtctgtgcggttcaggttccattccatgcgttcacggtcacctcccaccgctccatggcctccaccacagcggcggagtagtcggttgatgtgccccccgcctcccaggcgttttttgctccggccacgcccatgttgtacgccatggccgccttgtgcgggtccttatagtctgccatgtacttgcccagcaggtagcacccggcggcgatattcccggagggggtagttggatccagccccgtggccgcctccagctctgcgtggtaggcaccatccggccccggatttaactgcatgatccccacctctccggcggcgcccacggcctccatgttaaagtggctttcaacctccgccacggccagggccagaggataggggcactcataggccgtgcagtaggtccgcatatagtcctggtattcgtagcacataggcaccgccatggagaaatacccggaggccagcagggccttctcgatcttctccgcctctctcggatcctcgccctctccgtcccacacatccggctccgccgtcagcagggtgacaggcccacaggttgcggtgatctccagctcctccgccgccgctgtgtccgccgtcatagctttgatggccagtgccagcagcaggaccaccaccagggcaccggcaatcaggacagcgatccgccgtctggcaagctgccgcctccgttcctctgcccggatcctccgcgcttgctccatgcttttctttctttttttctcccattgctccgcctcccggcgggcctgcctgcggcggatctcctccagctggtcctccctgcggtggcgggcttccatggccccgatccggcgtttcagatcatccacatcctctaccgcgccccggtactgctccatggcctggcggtactccttggcctttctctggctcatgtctgcttgtcctccttttttccgcgggttgctctgcctgtcacctcgtaggtgtacccgaaacggcggcggccacactccgcgcaggtgattttctcgcaccgcccgtagacgggcttcacggtctttccccggcttgacaggaaaatggcgcagggcctacacaactcctgtttcattccctcgcctcccgttcatccacccaggccgcgcacatgtccgcctcctgtaagcgccatacccatggggaggctgccatggccgcgtccatgctcctggcgccggcggtggatgtgtcataggcacccatgtgccaccggatggccagcgcctcctccggcaacaggtccatgtggcgctggatcaagtataggcttttctctccatgtcccagcggcaggggatccttgtatgtatatccctcgtaatcctcccagcggccagtttccgggttctttcgccgcttggtttccgtgcaatagcagcccaccttgcacacatcatgcagcagggcaatgaccgccaccgtttcctcctgttcttccgaaagtcgatattctcccggatcttccttgcccgccatgtcgcggatcgcaatatcccgcaggcggtagtacacattcaagctatgcaccagcaggccgccggggtgtgccccgtggtgcttcgtggaggccggtgctgtgaaaaagtccgtttcccgctccagccagcccagcatggtgtccgcatagttccggtggatattgttttgaaaaatgtccttgaaatgggtctgtgttgtttgaagcccgttcctttccaaaaaattcatggctatacctccaccccctgaaaactttcctttaccgctccgccgcgtgtctgaaattccactgtatggaataggccccgtggatggatatacacgacgcggccccacatgggccggtgttccgcctttcccttggcgtcagcctcataaaaggtttgtggggtcctcactacctccgcgcccacctccaggcgggcgggccctccttttgctttgctcatgtgtcctccttttctcccggcgggatgtcgtatgccacccagtaaaccccgtacagatccagtaaatacccatctttgtcccgctctcccttgatacaaagccgcccggcatggacatgggtggcgatctcccagccagggcttttctgtaattggtgtaggccgatccactcaatccaaaccgggcgcggcttttggatctgttcaacctgggcgcgggtcatcggttttctttcgttctccacattgccctcctatctatccgtcggcgctccgccgccgttacgaactcctccaccatgccccgctcccagagatcccggagggtcagggaataggtggtgcggctcgccgtctttccggtttctccgtcccggatctcaatggataggagggggtggcccatgcaggttgagaaaaaggcgtgggccgtgttccattccggggtgatccagttcagggcgtagtccggtgtgcgcgagtatttaatgaactctgtcccgctccgcatgggcgggaggttgtccacataatccgccaccagcttatacagggcggttttattcgcttttagtcgcagcattacaggatctcctcccgataccaggccaggatccgcttggcgtacttcttgcggatccgcttctttttggtgcggtggtagcgggcggccagcggcctgttggccgcttccgcccaccgcagggccttgtggaactccgccgcctccttgatcgcctcccatgcgtctgccaccgctctggcggcctcctccagctgttcgcagaaaacgcggaacgcttccgccagatagctggccgcctcattggcctgctccatcgtaaaacccattgacgcaaggagcggcggcgccgggcgttccgctcgctccggcagggtgatttctccggcgtattgcaccggctgtccgtctatgtagactgccgcctgggcggttcctttcccgtcaggtcccatccggccagccctcccctcggtggtatcccataaggatctggtgtcccatttcccccagggcgtggcgcatgacctccagttccagcaggtcggtgtacttcatcccgtacccttccagcatggcggtcagcctcttggccttttccgtggtctttctcacggcctcccgctccttggccatgtcctccgcgtcgaactgtgcccgcaggtcctccaggccaatttcaccgcccgcgatcttctggcagaactccactgcctcctcccaggtaaattcccggtatcccgccgtgcttatctctctcccggcccctcttgtgtcgtagcagcttacggtgtggccccgttcctgtgcgtcccacagccggaaaatccgaaaaatgatcccgtcctggcgcccggtcatggtgccgcgcccctctctccgccacttgatttcctttctctttgccatgtccgtctcctttctccgccccttgcgggggcggaatttccgttgatacgctccgccgattagatccaaaagctgggggccagcgcccttgaatagtccgcgcggtggtggtagggcgtgccgtccgtgtagacaaggcagaaataatcgttgtagccggcataggcggaacgggtgtaatgcggccatgtctgcccgttccacatcttcacgcggtcccgctcggtcttgtagaccgggagctgctcctctgttggatcgtccccatctgcccacggcttgcgcccgaaaaactctgttgcactatgtagccatagcagatccgtggtcaccagctcctcgcccttgatggtctggcggatggtgcggggggtgatgatggacaccagatcctccgggagatcctggaccagatcgctgttgcaccatttccgggcgtcgctctctttccaggacacaggacgctccaggcggttatacataggccgctcggccacgccgtccacaaagcccatccagacccggcccggctccaccttttccaccatgatggccacctcggtgccgctccgcaggtggaagcggatcacatcccactccgccaggagcttgtccagtacgcccatttctctggccctggcgatctccgcccagttgatttcctctttcgtctgcttgatgatggttgccattgtcatttcctcctttgttttatccgcctccatggcggtggggtcactcattcattggccgcccgcgttctgttcaggggcttgccgcgccgtcggaggctttcctggaaacgacgctgggccagctccgggttgtatgccttgcggctattcttgtccagggtgccgttgctcccgcgcctcaattcctcgtaaatggttttaggtgccacacctaccaggcccgcgatctcccgcaccgacgcataagcggcccacttctctgcaatcagctgccgatccgcaggccccaaatatttgttgctcatggtcctttcacctccgttttttgataaaaaaataagagtaacaaggctttacgctttgttactcttattagtagcattttcaaagggcctgcgcctgtaagaaaaatcgtgcactttccgccaaagtgtgctatactatggatttgaattcatttcatccggaaagggtggttttcatgcgaaaagaaattctgctgcccgccgtggcggtggctggcggcggggccggctttgtcctgcgccgctgggagctggccacggcctttgaggcggacaccggcttacccattcccggcgccccggccactctcgccctcatcgccctttcggttgccatggcggcggttctggccctgctctgccggggcaaatacccctccttcaccggctacgacgaggcctttcaggccaagggaaacaccctgtacgccaccgctatggtgctctccgccttcctgctcttgggggcggcggtgctgatggtgctctcctttgtccaggggaccaacaccgtctacacccgcctgctgctggccgccctggcggcggtctccttcttctgcgtaatgcagacggcgcagaacagctttaagggcctggacaggggcaagtacagcttcaccctgctgatgcccgcctacacctgctgcgtgtggctgatcgccgcctaccaggtgcgggccggagatccggtgcagctggactatgtgtatgagcttttcgccatcatcgcctccctgctgggactctacttccacgccggcttctcctttgagcggggccgggtgttctgggctgggctgttctccctgctggggatctacttctgcctgaccaccctggccgaccagcacgatctggccacgacgctgctctatggcttcgccatcctctatttgctctcgtccacggtgacgcttctgtacaatgccggccggccggagctcctggcccgggccgaaaacgatacaacggagggaacgcccgatgaatcctgagaaattctatatcaccaccccgatctactacccctcggacaagctgcacatcggccacacctactgcaccgtggccaccgacgccatggcccgctacaagcgcctgcggggctgtgaggtcatgttcctcaccggcactgacgagcacggccagaagatcgaggacaaggccaaggaggccggcgtatcccccaaggagtttgtcgaccacatcgtggagggcccccggggcgtgctcgacctgtggaggctgatgaacatctccaacgaccggttcatccgcaccaccgacgactaccacgtggagtccgtgcagaagatcttcaagcagctctatgagcagggggacatctacaagggcaaatatgtgggcaagtattgcaagccctgcgaatccttctggacggagacccagctcaaggacggcaagtgccccgactgcggccgggacgtggtggatgccgaggaggaggcctacttcttccgcctgtccaagtacgccgaccgcatccggcatctgctggaggacaccgacttcctggagccccgcagccgggtcaatgagatggtgaacaacttcatcaagcccggcctggaggatctgtgcgtctcccgcacctccttctcctggggcgtgccggtggacttcgaccccggccacgtggtgtatgtgtggatcgacgccctgtccaactacatcaacgccctgggctacggcaacggccgctaccacgactttgagaagttctggcccgccgacgtgcactttgtgggcaaggagatcgtgcgcttccactccatcatctggcccgccatcctcatggccctgggcctgcccctgcccaagaaggtgtacggccacggctggctgctgctggacggcggcaagatgagcaagtccaagggcaacgtggtggacccctacctgctggccgagcgctacggggtggacgccctgcgctacttcctgctgcgggagttccccttcggcaccgacggcaacttctccaacgaggccctcatcggccgcatcaacaccgacctggccaacgacctgggcaacctggtcagccgcaccaccgccatggtgggcaagtacttcggcgagcgcctgccggagggctgcggcgccaccggggacgaggcggagctggccgccatgctgacccaggcccagggcgaggtgaacctctccatggacttcccggaggacgacccccggaagtacgacgtggagctcatcgccctggccgccggcctgcggggccgctacgaggcgcagatggagcactacgccttccaggacgccctggtggaggtgttcaagctcatcggccgggccaacaagtatatcgacgagaacaagccctgggcactggccaaggacgaggcccagaagccccgcctggcccacgtgctctacaatctgctggagtgcgtgcgcctttccgccgtactgctcaccccctttatgcccgagacctgcggaaagatcttcgcccagctcggcgtagacgaaggcgcgcgcacctgggagtccgccggagcgtggggcctgctccccgccggcgcggcggtgagcaagggggagaacctgttcccccgcatcgacgtggagaaggagctggccgccctggacgagctgcaggccgaggcccgcagggccgccctccccgccgtggaggtggagcccttcgcccaggagagcgtggacttcgacaccttctgcaagagcgacttccgggccgtgaaggtcaaggcgtgtgagagcgtgaaaaagagcgccaagctcctcaggttcatcctggacgacggttccgggactgaccgccagatcctctccggcatcgccatgtactacaagccggaggaactggtgggcaagaccctggtagccattatcaaccttcccccccgcaagatgatggggcaggagagctgcggcatgctgctctccgccgtccacaccgagcacggggaggagaagctccacctggttatggtggacgacgctatccccgccggcgccaagctgtgctgagcgcatcctgtataaacagagggggcgcgcctgcgtttgcaggcgcgccccttgctgttctctatcccctgtcccggcgcagcaggcgccggaagctcaggtcgatggccagggcccccaagggggcagtgaccaggatagcgactaccgccacggtgagcaccacctgcccacaggccaggcccatggccagagggacaccgccgatggcggcctgcactgtagctttgggcagataggccagcacggcaaacagccgctcccgtccgctcaggcggctccccgccacgcagaggagcacccccacggcccggaaacacagcacccccagcaccgtggccacggcggccagccctgccgccgcggcgtagccgatgtccacctcggcccccaccaggacaaagagcatcacctcggccgccacccacagcttaccgaacttggcagtgagccgctccgccgccggcctccgccaacggcgcaggcccaggcccgtccccagaacagccagcagcccggagaaggggaccaccccctccgccgcgtcctccagggcaaccagcaggaaagccagcgccagcagcaccaccaccttggccgagtcccgcaggtggaagcgggtgaagcatttagccaggacgtatcccagccccaggcccgccgccccacccagcacaatggataccggcacccccgccagggccgcaggggaaaagctgcctccctgagccatgccggtaaaggaggtaaagaggacgatgacgaacacatcgtccaccgaggccccggcgagaatcatctgggggatgcccttgtctgcgccatagccctcctccatcagcctgagcatccggggaacgatgaccgcgggggacaccgcccccaccactgcgcccataatggcggcgtccaacacgtccacccccagcagccggggagccagcagcaccatgcccagcacctcaaaggaagcgggcacgaagcacagcagcacggcgggccgcccggcccggcgcagatcctccagctccagggacaggcccgcccgggtgaggatgatcaccagggcgagctgccgcaggtctgcggaaatacctaacagggatgggctgagcaggttaagtacgcagggccccagcagaatccccgccagcagcatccccaccagggacggcaggcggagcctgctggccatggcccccagggccatgcccagcagcagcacataggcgagactggttaacataacaaattattcctctccagagggcagaaaaaaagccaatgccccctgcaatctcttgcagaagtcatcagccaagcggcggttcgggccagcgccccgggagaacctcattcccgtgttccggctgctatcctaccatacatcccttcccctgtcaagaccgcctttttcgatatccttagagattccttagaattacctgctatcctgtggacagaccacaaaaaggagctgtcctcaatggaaacacatcatatcacccccgcccgggggttgtccgagacggggctgaaatggatcgccctggtcaccatggtgttggaccacattcactactttttcagctttaccgggtgcgtccccgagtggttcagtatggtggggcggctgggcgcgcccctgttcctgttctgcctggtggagggcttcacccacacccacagccggaagcggtacttcgcaagggtctacgtcctctccaccgccatgtccaccctgctgctgcttatggccttcggcggactgctggtgcggcctgacgggttctaccccaccaacggcatgatgaccacctttgtcattctcatggtgatattccagggcatcgactggctggggcagaggcgcatggtccggggcctggcggcgttcctcctccccctggcctggccctttctggccaccgggctgctggcggcgctccccgccctggcctccccgctgggcatcgcctgctacaccgtcctccccatctggggcgtcaccggggacagcagttggccggtgctggccatggggctggtgctctacctgttccgccggaaccggagggcgcaggtactggccttcgccgtgttctacttcctctacggggtggtgtatatgggcctcatggcctcccagatgcccgactttgcgtggacgcagctcttcacccggtactacgagatctacggcatcctggccgcgcccctcatgctgtgctataatgggcagcggggcgggggccacaagcggctgttctacgccttctatcccgcccatatctacatcctctacgccctgtcgtgggggctctatcttctgctgaactgaggtggtatccatggcccatattctggtggtggacgacgacggggatctccgcgccctgctgaaaaccgccctggagcgggacggacaccaggtctccctcctcgaccgcggcggggcggtgagcgaggcccactgccgctgggcggactgcattctcctggacgtgatgatgccgggggaggacggctttgccacctgccgccgcatccgcgccctggccgcctgccccattctttttctcaccgccaagaccgaggaggccgacgtgctcaccggcctggggctgggcggggacgactacctgtccaagcccttccgcatcgcggagctgcgggcccgggtggccgctcacctgcggcgggagtcccgggcgccccgcagccgcatccgccgcggcgggctggacttcgatctggaggagcgggccgtctactgcggggaggaaccgctgcacctgacccgaagcgagtatgccatctgcgcccatctcgccgcccaccccgcccagaccttcaccaaggagcagatctacgaggcggtattcggctttgacggcacggcggactcctccgccatcacggagcacatcaagaacatccgcgccaagctgcgggccgtggggctctcccccatccagaccgtgtggggggtgggctacaaatgggaaagcgcatgaggcggcggacggggctcaccgccctgttctggcgctacctgctcgtcaccggcggagcggtggtgctgctggccgtcctctggtggggcggcctgtccgccctgctccgcagcggctttgtcctcccggcgggcaccgccgccgggcaggcggacgggctggtccgcgccctggaggccggggagctgaccccggcggagctgccccactactaccgctgggccacctttgacggctccgcccaggtggtggggcagcgcggcatggacgggcggcgcctgggctatgcccgggccgcgctggagggcgaccgcaccctccacggcttcccctaccagcagtaccaccgctccgcccagctccccgacggcacggtgtgcctgctccagttcgactactccatgccctacggctcccccgcgctccaagagagcctcccggagttccagacctgcgccacggcggtgctgctggcggcctggctggccgccggggccctctccacccggcacttcgccggccggctccggcgggacgccgccctcctcaccgccgccaccggggccatcgccgcccggcggctggacgtccccctggacgggggcgcccgggtgcgggagctgggggagagcctggccgccatggagcagctccggcaggccctggcccggtctctgtccgagcagtgggccatggagcaggagcgcacccaggcgctggccgccctggcccacgacctcaagacccccctgtccatcgtcagcggcagcgcggagctgctggaggaggacgccctctcccccgcccagcgggagcgcgtggacgccattctccgcagcgccggacgtatccgggactatatggagcagctgcgcgccctcaccgccaccgggggcccggcggaggcgggcggacgggcgacggcggagctgtccgcgctggcggagggctgggcggccgctgggcgcggcctgtgcgcccccagggggctgcgcttttctctggactgccccgcctcccgcccctgtaccctgttccggtcagagttggaccgggcggtgctcaacctgctggacaacgccgcccgcttcaccccggaggggggcgcggtgcgcctgtcggcgtatgtggaggaggccgtactcaccgtggccgtggaggactccggccccggcttctcccccgaggccctggcccgggcggggcggggcttttacaccggcgacgccagccggccccgggagggccacatgggcatgggtctcaccttcgcccgccagaccgcccgccgccacggcgggacgctggagctgtccaacaccggccggggggcccgggcggccctcaccctgcccctctgaagaaggcggcgcggaaaaccgcgccgccttcttgtatttttccccgttccgcgctatcatagagggagaacccatcccaacactgtgaggtctgccctatgatttttgacacccacgcccactactacgacgaggccttcgacgccgaccgggccgcgctgctcgcctccctccccggccggggggtggccctggtggtctgccccggctgcgacccggagtcctcccgccagtccatcgccctggcggagcggtacggctttctctacgccgccgccggataccacccggagaatctggagggggcggccctctccgacctggacgccgtcaaggccctgtgcgcccacccgaaggtggtggcggtgggggagatcggcctggactactactggctcaagacgccggaggagcgggccaactcccgggactttttcgacgcccagctctccctggcggaggaactcaacctccccgccatcgtccacgaccgggacgcccaccgggactgcctggacatcgtccgcgcccaccccggcgtccggggggtgttccactgctactccggcagcctggaggacgctagggtgctggtagaccggggctggatgctctccttcaccggcaacatcaccttcaagaacgcccgccgggcccccgacattctccgctggctgcccctggagcggctgatgctggagaccgacgccccctacatggcccccgagccgtaccggggccagcggtgcgactccaccatgatcgcccgctccgccgagacggtggcccagctccggggcctcactcgggacgaggtggaggccgttaccctggagaacggcaagaagttcttcggcatcgcctgaggggcggacggcccccggccgcccgtccgtcctggatctgaattgataagggaggtaatccactatgatgaccatttcctatgagtatgagggcgcgctctacgtgaacctcaccaacaggtgcgactgcgcctgcgtattctgcctgcgccacaacggccacaagggctccatctacgccgacaacctgtggctggagcacgagcccacccggcaggaagccctggacaacctgctggcccgggacttctcccagtaccgggagctggtgttctgcggcttcggagagcccatgtaccgcaccgacgacatcgtgtggctggtggacgagctgaaaaagcgggtgcccaacctgccaccggtgcgcatcaacaccaacggccacgccaacctgttcctgggccgggacgtggcccccctgctccaggggcgcgtcgacaccatctccatctccctcaacggctccacgccggaggagtactgcgccgtcaccaagccccgccagggcatgcaggcgtgggacgccatgctggactttgcccgggagtgcaaggagtacgtgccccacgtggtcatgaccatcgtggacaaggacaagacgccggaggagatcacccgctgccgcaggctgaccgaggacttgggcgttacccttcgtatccgggcctatatcccggactgaaacagctctctcatatgggcaggcgcgcccggcatagccgggcgcgcctgttgttttgtctctatgcggcggagtcctgctccagctcctccagcgcctcccactcggagtcggcggagaaccggaagcggcccatctggtcgtaaacctccacatgcccacgtacatagcgaatctcgtaattcattggtcagcgctcctttctgtctcgttgtgagtacagtataggaaatgcactgtccaataaacaggactatttcttcaagtccgcctgaaactgctcccacgcctcggggcgctccacaaaggctttggggcagagcttccccgtcacatcatagtggcggatcacctggctggtgtcgaggccgtactcctccatgagccagcgggtgagacgcaccagggactcataggtggcagaggtgaattccccgctgtcgtccgggtggcagcactcgatggagatcgtgtcgtcgttgcgctggttggagcagtaggccacctcgttgagcgggacgttctggagcacctctccgtccagccccaccaggaagtggctggaggcgtaggtctcccccgtctgggccaggttggtgaaaaagctgtggttctgcgccgccgtggtacccgggttgcccacgtagtggatgacgatgccgttgacctcctccagaggcgtgccgggccgggagaactcgttgagggggagcagctccaccgtgatccagtccggcgtctccggcagggggcgctccccgggggcgaaggggtcgatccacttgatgaccagcagcaccgccaccagggccagcagacacggaatcagccggggccggtgcctcacccgccgccggcggcgtaccggagtctctacgggcatgcttccccctcctttccacaaatttatctctattatagcagggttttgccccgccgtcttttacggttttcttacgttttgcctccgcccccgcgggatctgcccggtcggccggacaaaaagccccccggccggcgccggggggctggtttatggttcgcggagggcctggtcgaaggccgccttgacctcgggcagaaagcagacaaaggtgacggtctccaatgtgttatcctgcgccgcaaaatcacgcactgtattcaccgcgatggcggccgcctccgccagcgggtagccgtacaccccggcggagatggcgggaaaggccaccgtccggcagctgtgctccacggccagggtcaggctgctccggtagcaggaggccaggagctccgcctctccgtggccgccccccttccagatggggccgggggtgtgaatcacgtattttgcgggcaatttataaccctttgtaatcttggcctgcccggtctcacagccgtggagggtacggcactcggccaatagctccgggccggccgcccggtggatggctccgtccacaccgccgccccccagcagggtgcggttggcggcgttgacgatggcatcggcctcaatccgggtgatgtcgcccagcacgcactcaatccacgccatgctcctcctcctcgcgggcgtcctgctccgcctcggcctccacagcctgataggccgccgggggctggagcgccgccgggtcggtaaagacctgctcgaaggtcttggcgtccatgttctcgtactggagcagatactccgccacgatgtccagctccctccggcgatgggtgaggatctccccgcagcgggcgtaggccccgtccaccagggccttcacctcctcatcgatgagggcagccacctcctcggagtagttcttggtctgggccatggagcggccgatgaatacctcgtcgtggccggagtcgaagaccacattgcccaccttctcgctcatgccgtagcgggtgaccatgttgcgggcgatggcgctggccttttgcaggtcgttgcccgcgccggtggagatgtcccccaaagccaactgctcggcggcccggccgcccaggcagacggcgatgcgctcggtgagctgctgcctggtctggaaggtcacgtcctcctggggcagggagatggtcatgccgccggccatgccccgggggatgatggtgatctcatgcaccgggtcctgggtgggcaggtcgtggatgacaatggcgtggcccgcctcgtggtaggcggtgagcttccgctcccgctcgatgaccacccggctcttcttctccggcccggcgatcaccttgatcaccgcctcgttgagctcggccatgctgatgaagcggtggtgtctgcgggcggccaggagggcggcctcgttcatcaggttctccagatcggcgccggtgaaaccgccggtgcccttggccagctccgccagggacacgtcgtcccccaggggcttgttgcgggcatggaccttcaggatggcctcccggcccttgatgtcggggtgtcccacgtatacctgccggtcgaagcggccggggcgcaggagggcggggtccaggatgtcctgccggttggtggccgccatgaccaccacgccctcattgttgccgaagccgtccatctccaccaggagctggttgagggtctgctcccgctcgtcgtggccgccgcccaggccggcgccgcgctggcggcccacggcgtcgatctcgtcgataaagacgatggcgggggcgttcttcttggcctggtcaaacaggtcgcggacgcgggaggcgcccacgcccacgtagagctccacaaagtcggagccggagatggagaggaagtgaacccccgcctcgccggccacggccttggccagcagggtcttgccggtgcccggcgggcccaccagcagcacgcccttggggatgcgggcccccagctccagaaaccgcttggggtcccggaggaactccacaatctcctggagctcccccttctcctcctcggcgccggccacgtcctcaaaggtgaccttcttctgctcgtcggcgccggtgcgggtgcgggcgcggccgaagcgggcggtgcggtccacaccgccgccgcctcctccgcccccgccggccccggcctggcgcaggaacatgaagtaccacagcaggccgaacaccaccaggatgacgatccacgggataaagctcatccagtagggaggcacccaaccctggggatagtcgtagtcggtgatgatcccctgccgcttctgttccacaatgaggtcgttaaagtcctggtagaaccagtccgggttgccgatctgataggtgagcacactctggccgccctggggctccttcaggtacagggtcacggtattgtcctccagggagacccggctcaccatctgctgctccagcagctggcgcacctgggcataggtgaccttctcctgattccccatcccgccccggagggcgaagatggtcatcagcagaaccacggcgatgagcaggtaaaagcccacatcgcgcaggcttccgtttcgtttcaaactgcggacacgtcctttccgggcagattgggcgcctcaggcgcccgttattcctctcctccgtacacacagggcttaagaatgcctatgtagggcaggttgcggtatttttccgcatagtccagcccgtagcccaccacaaagtagtcggggatggtaaagccggagtagtgcagctccacctccttggtgcggcgggagggcttatccagcagggtgcacagccgcacggaggcggggctgcgggcctggaggagctggagcagatagctcagggtgttgccgctgtccagaatgtcctccaccacgatcacgtcgcggccctcgatgtgctcgctgagatccttgatgatcctgacctgcccggagctggccgtgcccgccccataggaggacaccgccatgaagtccacggtgcagggcaggtggatctggcgcaccaggtccgccataaacacgaaggagccccgcaatacgctgaccagcaggggctccctccctgcgtagtcccggtcgatctcggcggcgatctccgccacccgccggtgcagctcctcctcggaaaagagcacccgctccacgtccttgtccagcatgtgttccatacctctccctcactctttcttccagaataacagctcataggccgcctgtccagggacggccgtccggctctgctcaggcccgaagcccgccaccgcggccacgccccggccgtcggccagaaccggaatccgctcccgctcccggcggggcaccttttcgtcaataaacagcttttttagcgtcttggttccaccccgcccgggcagggtaaccgcgtctcccgtctgccgggggcggagcaccaggggaccctccagcgccccctgggccagatacagggccccgggcttccgctcgctctcgtccgggcagcgtaccgggcggcagcgcacccgccagggcgtgccctccacctcggtctcaccgtccagggccagaggcgtgggcagaaaggggggcagggggtcggactgggtggtgagcagcagctccctgtatacccgctgagccagccgtccgccgggcaggaacaccacggcggaggggtcgtctccccgggccagctccaccaccgccttgaggtgggcggcggagcagttggtgctgccgtcccccatcatctccagcaggcggcgcaccgcacggggggcgatagccgccgggagctgggcgatgtacctggcctcgatcaccaggtcgtcctccgcccaccgggcgttctgacaggccgcggcggcctgggcgttcagatagtcgttgtcggtgcgcaggtagcccatggtctccgccgcgctctcagtgaggcggggattgagctgacgcagcaccggcaccacctggcggcggatgcggttgcgggcgtagccctcgtcggtgttgctgctgtcctccacgtgggccacgccgttggcctccaggtaggccacaatctccgcccgggaggtggtgagcagggggcgcaccaccactccccgccggggcgggatacccgccaggccatgaagccccgccccccgcaccaagtggagcagcagggtttccaggttgtcgtcggcgctgtgggcggtggcgatgcgtccacagcccatggcgtccgccgccccccgcaggaattcatagcgcatctggcgggcggtctcctccacccccaggccccgggccctggcctcatgggccacgtcgcccgcgccaatgacgcaggggatgtcctgcccggcgcaccactccgccacaaaggcggcgtcccggtcggattcggccccgcgcaggttgtggttgtagtgggcggccgccacccggaagcccccctctccggcccaggtgtggagcaggtgaagcaggcacatggaatccgcaccgccggacacggcgcacagcaccgtgcccccccgggggagcatgtcgtattcggttgtcagggctttgatggtttccagcataaagtctcctttgcggcgggcggatgtgggcatccgcccctacgtagggggcgatgcctacatcgccccattccgcgtcaatattcgctgtgcctccggtcgatggacgagaaggtggtgtactcgggcagccactggagctccacggtgcgggtctcgccgtggcggttcttggcgatgatgcactcggccaggttgtggttctcgtcgctgtcgttgtagtagtcgtcccggtagaggaacataacgatgtcggcgtcctgctcgatggcgcccgactcacgcaggtcggagagcatgggccgcttgtcggagcggctctccgggccgcgggagagctgggacaggcacaccaccggcacgttcagctccttggccatgatcttcagggcgcgggagatgtcggagacgatctgctggcggttgtcgccgctgcgggtgggcccgccggcggaggtcataagctggaggtagtctatgaccaccagccccagattatccacccggcggcacttggcgttcatatcggccacggagagggaggggttgtcgtcgattaaaatctgcgtctggttgagggccgccgaggcggcggcgatcttggtccagtcctcctcccccagcttgccggtgaccagctttttgttgtccacaaagctctcgccggagatgaggcgcatggccagctgctcccggctcatctccagggagaagaagaccaccgtcttgccggagaacttgcccgcgtggaggagcatgttcagggcgaaggaggtcttgcccatgccggggcgggcggccaggaggatcagatcggacttgttcagccccgagatggccatatccacgtcgggcaggccggtggacaggccgggtaccgccgagtcgctggcggccagctcgttgagccgctcgtacacattgaggatgacgctggagatgtgggccagaccctgggcggaccggccctggcggatggcgtagatgcgctgctccgccgcctccagcacctcctgggcggtgccggtgccctcttgcaccatggcagtcagctctcccgccgtctcggcgatgcgccgcagcagggccttgtccttgacgatggccacgtactccttcacgttggccgccgtgggggtgatctccatgagctggaggacgtaattgcgggaggtgttctcgtcgtacaccccgttctgcttcatgtgctccagcaccgtcaccgggtcgatggtgagggagaagttgaacatggagtagatggtctcatagatctcccggttggtgcgcagatagaagtcctccggccggagggcctcgatcacctcgggcacgcagcgggcgtcaatgagcatggagccgagcacggactgctcggcctcagtgctgtggggcatctgccgggtcaaaagctcctcttcacttggcatgttcctcacctccgggagcatgaaatgcgggcgggataaaacacaaacgccgcaggggcgacccctgtgagcgcccgcgggcggccataaaggccgcccctacccagggcagaccggctgagcgtatacagggacggcctctttgccctcccgttcccggttcaggcctcggccacgaccaccttgagggtgccggtgacctcgtaccccagcttgaccttcagctcatagccgccgaaggccttgatgggctcgtcctggacgatcttggtcttggggatggcgatgccgtgctgggcctggagggcgtcggcgatctccttgctggtcactgcgccgaacagccgcccgccgttgccgcccttggccactaccttcacggtcagctccttgagcttggcggcggtggcctctgcctccgccttctcggcggcctcctgggcctttttggccttctcctgcatcttcatggtgttgacgttctccgccgtggcgggcaccgccagcttccggggcaggagaaaattgcgggcgtagccgtcgctggcctcgatcatctggcccttcttgccctgacccttcacgtcctgctgcaaaatcactttcattgggataacttcctttccaaatctcaaaacttattcaatagggcacgtgaaattccgacacccgccagccgtcggcggtgcgctccatgcgaatgggccagcgctctgtgctgagcgggcgggcgcccgtctcatccggctgcacggtcagatcggcgtaatgccccaccaagtaaaactccacagcgtcctcgctctggctcaccagctcataggtgtccggcacatcggcccagccatactccaggctgctgccccgctccagctccaggaagcatgtccggccctccccatcggcggtgaagatggggaatcgctccccgtccatattctccgtccacagcagctcctcctggtacgccggggtgaagatgccgtccagcatggcctggaagtcctcccaccgggcgtaccgcccctgggccaccagataggtccagccgctgtccagggtgaccgtctcatagtcccccagctccggcggatcgccgccgtccaggggatagctgtccacgccgctggtggagcagcccatgaggaagctggcggcgctgtacgcccgcaggaagagcgcctgctgctccgcgtccaggaaagcgggcgccggctggtccgccatccagtccgggatggggggctccgccggagctggggcctccgtcgaggccggagtgacctccgccgggggcgtgggggcctctgccgccggggcggtgcaggcacccagaaccagcgccaggccggccgccaacagcaccagcggtcgtttcacagttctcactcctcctcgagatatgcgtcaatggcctggaggagcatatcgttgacctcgtccacgcctttgcccggcacctgggcgccggcggtggcggcgttgccgccgccgcccagcttctccagcaccacctgtacgttcacgtcccccatgctgcgggcggagaggatcacccgcccctcctggtcggggaagaggacgaaggaggtgtcgatgcccgagatgttgagcagctcgtcggcggcctgggcggcggtaatgcggcccacggtgtggtccaccttggctacggcaatgccctcatggtacattttggcgttctgaataatgtcgtacttggcgatggtgccctccaggtcgttctggaacagcttcttgacgtcgccggtgtccgcacccgagcggcggagaaaggcggcggcctcaaaggtgcggctgccggtacgcatggtaaactgcttggtgtccagtaccatcccggccagcagggcctccgcctcggtcttgagcaggtcggcgggctccagcaggtactggagcagctcggtgaccagctcgctggcggaggaggcgtagggctcgtggaaattgagggccgcgtcggcaatataggaggaggcccggcggtggtggtcgatcaccgccaccttgtgcactgcctccagcagatcctggctcaccacctgctcgggccggttggtgtccaccaccaccagcaggcagttggcgtcggccagcaggatggcatcctgctgggagaggaacacatccttgtactcgcccagcccccccagccgctcggacatctcgctggccgggttctgcccggcctccttgatgatgtgcaccggcgcgcccttcttccgggccatggcgcacacgccggcggcggcgccgatgcagtccatgtcggggtacttgtggcccatgacaaacacccgggaggcgtcggccatcagctcgcccagggcgttggccatgacccggctcttaaccttggtgcgcttctccagctccttggtgcggccgccgtagaactcgaagttgaacttgttcttgaccaccacctggtcgccgccccggctcagggccatctccaccgacagggccgcgtactggaacagctcggccaacgtctcggcgtccttgccgacgccgatggacagggtggcctggatgcccgaggggctgaccacctcccgcaccgtctccaggatggagaacttgccctcctgaaactgggccagaaaccgctcctcaaagacaaagaggtagcggtcccgctcgtaccggcagaacagcccctgagccggggccacccactgggccagccgttcgtcgatgccgctgcgcatggcggagcgggcggaatcggtggcccccttcatcagctcctcatagttgtccacggtgagaatccccaccaccggccgggtggaatagtagatgtcccgcacctgggcgaagtcggtgacgtccacccagtaggtggtggccaggtagccccgcccgccctgatcctcggtgcggaccaggtggccgaagaccaggaagcgccgttccccgatgcgcacctcggtggggcactcggttttcccctccataagccagcgggaggagaagtcgggcaccgccgcggtaattttggtgtcgaacaggtgctcccgctcgccggtgagctggagaaagcggtcgttggaccagatgacctcgtcgttctccggccggaagatcaccatgggcagcggggcgttgaccatggtatccttggtagccgtatccatgttgcaggtgacgctctcgatgtatttgatgatctccttctgcctctgggcgttgctgcgccggaagtagaggtagagcaccgccaccaccgccgcctcgatcaccgccactgccacgctgaacagggccgacaccgcggcgaagaggagcaggaacacaaagtagagccgcaggctgggctccagcagatgggtcagcttgtttttccgcattgagacacctcccaagcaggtcgttcggtgcagaacacacataataagagatattattatatcaaagggccgccccaaaaacaagcccgcttgccctggttcttgccttgtgatagaatattccgggtattgtatcatgctttacattcttttttcccctgtactgccatacttttggaaaacaaatgaacgatcgaggaggcattcccatgaaggaatatcccgtgcagcgcgccgcggtgctcaagccgaagcccgatcccgacacgctggtcttcggcaagacctttaccgaccatatgtttatcatggactacaccgccggccagggctggcacgacgggcgcatcgtgccctacggccccctcgccctggagccctccgccatggtgctccactatgcccaggaggtctttgagggcctgaaggcctaccgcggccccgacggcggggtgcagctcttccgccccatggagaacgtccggcgcatcaactcctcctgtgagcgcatgtgcatcccccccctgccggaggaggacgccttggccgccattgagcagctcgtgcgcctggaggccggctgggtgccctccaagccgggcacctccctgtatatccgtcccttcatcatcgccaccactccctccctgggcgtgcacgccgcccacgactacctgttctgcatcatcacctgcccggtgggcgcatactacgccgagggaatcaacccggtgaagatctatgtggagaacgaggacgtccgcgccgtcaagggcggcaccggctacaccaagtgcggcggcaactacgccgcctccatccgcgccggggagcgggcggagcagaacggctacgcccaggtgctctggctggacggcgttcaccggaagtatattgaggaagtgggctccatgaacgtcatgttccaggtaggcgataccgtgctcaccccggagctcaccggctcggttctgcccggcatcacccgcaagtcctgcctggagctgctgaagtcctgggggctgaaggtggaggagcggctgatcaccgcccaggaactctttgacgccggggccgacggcacgctgaaagaggcctggggcactggcaccgccgccgtcatctcccccatcggcgagatgggctgggaggaccagcacgtggtggtcaacggcggcaagatcggccccctggcccagcgcctgtatgacaccctcaccggcatccagtggggtacccggcccgatcccttcggctgggtggtcaagctctgattttgcgctttttccctttccatataatttccattctgaaacgccgtgcggggccgcctcatgagaggcggccccgcacggtttaacctccggttttcttttcccggccaaaacctgaacaccgcgcccttgccctccgctccgccgtctgctaggatagaaccgcaggggcggcccacccgctctcgcgcagcaaggaggcgtctgtatgaaattgaacgaaacgatccgccgcctgcggcgggcaaaggggctgacccaggagcaggtggcccaggccctgggggtaagcggcccggcggtaaacaagtgggagcggggcgcatgctgccccgatctcgccctgctggccccgctggcccgcctgctggacaccgatctgaacactctgctctccttccgggaggagttgaccggtgcagagatcgccgcgtttacagaggagctttacaccctggcccagagcaggggcatcgatgcggcctttctgcgggcggaggagctgctccaccggtggcccgggtgcgaccgcctgaccatctctctggccatgacgctgaacggcctgttcttcaccctgggcgtggccgagccggagccctacgagcgccgtctggagcctctgtaccgcgctctggccgacagcgaggagccggatatccgggaccaggccctccacctgctcatcggcagacacatgaggcgggaggagtacgccgcggcggaggagctgctctcctccctgtccgaccgctggccccaccgggacgctttgcaggcggggctgctccgccggacaggccgtggggaggaggccgcggagctgtgggagcggcggctgctcaatgccgcgacggaggtctacgagtcattggtcagccttcaggagctggccctccaggcggagcggctggaggacggggcccggctggccgccctcattgaggagacggtggagcgttacgccctcattcccggcgtcgcctcctccggacggctccaacaggccgcggcagagggggacaagacggccgccctgtctgccttgcgggatatgctggaggcgctcaaccgctcctgggacggcggggggctctatccccaccttctgcccggtacgcaggtggccgtcgggtccgttctgttgcccggcctgctgctggagctccagcgggagcccgaactggctttcctccaggacgagccggaatttcaggccctgctgaaacgctatggcggcgggacgcattaagcgtccccccgccccagcttgtcgaaaaagtcctttcgacaagctgctggacttttgaacacttcaaaaaagtgctcaaaagtcgtttgattggacgtgaaagacaaccctgacggttttccttcacactatctttccctccgaatccttcagatagagggtttatcgacagtctgtggcggcgggacgcattaagcgtcccgccgcccttctctttttcaccgtcctgtggtacaatggcggaaataatccaacacggaggtgatcccatggtcaagcgccgcgccctcctggcgctgctccccctgcttctcctggctggctgcaaacaaccggagaagttttccacatcctctggcgtatctgtggaaaatccagccgccgatgcgctggcctccgcccagctcggggagctggacggcctgctctccgaggcggagctggcccacgtgcatacccttgtggaacagctcctccccctgcgccaagcccgggagggggaaaatcggtggcggttgtccactgaggaggccaatctggtggaccgcctcaaccggctctatgagcggtacacgctcaaatacctggggggcggcgggtcctggggctatgcctctcccgccgagcgcccgctggccgactatgccgtggagccggacggcggcctccggctgacctctggggaggatatctaccgttccctgtgggcacaggtgaacgcccttctgcccgagggtgccctggacggcttttcccgcttcactgtctttaccgacggtctggatgaaaccctggcctatgtttcccccctggatgacacagggacgcggtgggaactggcagtggacccggcggatgccggggagttggactggtttaccgaaaccgtcctccacgagtatacccactacctcaccctcaacgacacccaggcggactacggcgctccggagagcggcgcccggtactgcgaggagggcatggtcgcccggtccggctcctatctggatgacttctaccacgccttctggacggactacctgcatgaccgcctggccaatccggacagctatggcttttacctccggcaccaggcggatttcgtcaccgactacgcctccaccgacccgtcggaggacattgcggagagcttcacctactttgtcctgtgggacgccccggagggggatgccgtctgggaggagaagctgaactttttctaccgctatcccgagctggtggagttccgcacccaggcccgggcccggctgggtctctagcagaccagcgcgcggaagccccggggggccccggagcggaacgtcctctcctccccggtgaaggggtcggtcagagccagctcgtgggcgtggaggcacaggcggcccagcgggctggcggccgcgccgtagtcccggtctcccgctacggggcagcccagctcgctcaggtgggcgcggatctggttcttgcgcccggtgtcgatgtccacctccagcagggtgtactcccgccccgcctggatggtgcggtagtgggtcaccgcctccttgccgccggagcggacggagtagaccttgtgggcggcgttctcccgcagaagggtgcggatggtgtcctcctccctggggggccggccctccaccaccgccagatagccccggcggcgcaccagcgcatcccagtgctcctggtaggcccgcttggcctcctcgtctttggcgaacaggagcacgccggaggtgtcgcggtccagccggtggacgatgaacacccgccctccgggcctggtgcggcgcacgtactcccccgccatgcggtaggcggtgcgcaccttctcccggtcgctggccatgctcagcaggccggagggcttgtcaatgactaggatgcgcccgtcctcatagagcaccgggaagggggcccgccgcgcctccgccccctgggcgagcacgctcacccgctggccgggggcgagggggtggtcgtggcggcggacggccgccccatccacctgcacctgcccccgggcgagcagcgacttgacatggttgcggctccccttcacgtgctccagcaggaagggcagcagcgggccgccccgctccacggtaaactgcatctctttcacaccatcacatcctaggagggatttttatgaacgaagttctgtcccagctccacgcccgcaagtcggtgcgggcctttctggaccggcccatttccccggaggcccggcgggccatcctggaggcggcctgcgccgcccccacggcggggaaccagcagctctataccattttagacattaccgaccaggccgtcaaggacacgttggccgacacctgcgaccaccagcccttcatcgcccaggccccgctggtgctccttttctgcgccgactgccagaagtggtacgacgcctttgccgccgggggctgttccccccgccgccccgggccgggcgacctgtggctggccctgtccgacgccaatatcgccgcccagaacgccgtcaccgccgcatggagcctgggcatcggctcctgctacatcggcgacattctggagcaggtggagacccaccggaccctgctccgcctgccggagtacgtggtgcccgccgccctgctggtgtttggctaccccacacagcaacagcaggagcgggaaaagccccgccgccgcgccttggagcacatcgtccacgagaacgcctaccgccgcatggagccggccgagctggaggctatgctggccgacaacgccggagcccggccctacggtgcgtggctggacgccttctgcaagcgcaagtacaactccgatttctcccgcgagatgtcccgctccatggccgagtacctcaagccctttctgccgtaaaaacgcccgctcccggttttggctggaaaccgggggcgggattgcattttccagcctgcttcggtaaaatggagccggtaccagccaaccgggaggagagatgcttatgagtccagcagatgaagcatgggtgaaggaactttatgaagccaatgccctcaaactgtataaggtcgctttccgccggctgggcgataaagacgaggctgagaatgtcgtacaggaggcattcttattgctcctggctcggtttgataccgtaagagttcatccaaacccctccgggtggctgatgaaagtcgttcaaaacctaatccgccattctatggacaggaaccagaagcaatctagccatgaaatttccatagaggaacaaatcactcaaatcagcgcccctccaaaacagtttttttctctgcgcgatatactgccgccgggcctcacccagcgggaacaggatctgttggtctggttctatgaggaagggctgtcctacgaggagatttctgcacggctgaagattccgatcctgacctgccggactcagatgttccgggcaaagcaacactataaaaagctggcggaaaaagaaacagatttttcagaattgatgtaatgtttctatcagtctttctgatattcctaagaaggaggtgtcatgatgcccgagaagaaacgagccccacaccagtcgggcagagggaagggcaacgtctctcaaatccaaggacatctgtgcgacaaaacagcggacgagctgttgacagagctggaagccaggatggatgaaatgacagaccttacctatgatgaggatgtgattgactcctatctggccgccctggacaaaaaagctcctctcgaaaaagattttgatgtggaacggtcatgggaaaagttccgttcacagcatgcgattttattcgacgaggacattttgcccaaaccggaggttccccaaagaggatctcatggattccgtttccgcagagccttcgcaagagttgtcgttgttgcggccatcgtcgccgtattcactatgttttgtgcacaggccgctggcatcgacgtgttcggtgcaatcgggcgatggacggaggagacattccgctttgctgccccggcaggccctgcaacttccgcggtttccgcagttcctgttgacattgatggggttctgatctacgaagtggagcaataccccacgcttcaggatgcttttgacgcccactccatttctgaaccgctggccccgtcctggattccggaggggtatgtgctggactatgtggaggccagcccttcaaccggacaggtcgtattcactgcctcctacagcagcggtcagagcatcctgaaccttatgtattcctatcgaatggacggcaccttttcctcatccatctttgaaaaagatggttcctctgtgatcgagtacaccaaaaacggcattgtccactacatcatgtcgaatgtgaatgtacgggtggctgcctgggtgaacggtacctgtgagtgctctattacgggaccgttgaccgaacaggaaatgatcacaatcattgattctatttatacataagagaggagcagtcaactatgaaaaaatctctgcgctgcatctgtgcagcaatttttgcgctggccttctgcacaggcttcgtcatccatgcttcggcggttgagcgggcaagttcctatcttacgagatattctgccacgcttttcgcgggtgaccgcggcgccgttgaaataacgatttccgtcgtcgcaaatcaacgtgtttcagaactgggcgccagctacattttgttggaggagtccgacgatggcggaaggacctggagcaccgccaaagagtacgagggcgaaagctggatgaccgccgaaaaccgctccagctacagcaggaccctttcgtatcagggaaccatcggacatcaataccgggtaacggcggatgtctttgccagagacgccaacggcatcgacagccgtaccactcccacctcctccgcggttacggcaaaaagataaatagctctattaccaactatattttttctattttgtaatgatcgtttatttgtattataaccggctgatggaatgacttcgcattccatcagccggtttattagaactcgtctgtttcctcttccttaaaatgtttgccgcaatgagggcacactgtgatatttcgcccccacattggaaatcgcttttcacagtaaggacatttaggacgagcatatcgtcccagccatacacaattcactgtgactatggccgatccaaagaacacctcgcctgatatcagagatgcaatcaagagaaatatcaaacaacctaatgaagtaaaaaaacctactcgtgtgctatgcacgctctttaatttcatatttaccttggtgttaacagtcaagctctaatgtagttactgtatttacgtcaaaatagtatagcgtttcataggatcgatatatatattccaccgtaggttcgatctctacttcgtaagtcttgtgctctccaggatccattcggaagcatactgctgccggaactacatcaaaatttatgccctggtctgcgacactaagtcccattttaaaaatagcctctgttccaaatgggtcgatttccattttacttgcttgtggcagtatcgtatttaaggtttctagtactacaccaacataccctgcggcatctttaaaaatgcccaaaatggataaagcagctgataagagagaaaatactgtatccgattcaccagtatccacccccggcggggcttcataaaatctgagaaaagcacaatcctttgtggtagtaccgataattttaacctgactcaaataaacatttgctaaatctacttgatccgataattcttcacagtaagtatatggcgcaagtagcaaaagactatatctagtgtcattccctgcctcagaaatagccccttccggtttaaagtatgcgtaaaaatccattcccggcccactgagtccgtagttattttttggcaccggcagggtaaacacttccacttttttatatccttttggcgtcgtaggggtacttgccagcgctaactgaccatctaaatcattcgtatcttcggaatatagaggatgcagtgcttttatctcgtctgtataaacggattcaccgactctaagaaatacagggaactcctcactatcttgttttttcattgaaatacctaaacaggccccttccgtacctatccgtttctggaacgaagacataatatggtaggtttctgtgcctatggagatctcgccctccagcggccccccttcaattagagtaatgtcatcagaaagttctacttgctccagttggccctccagatgagtctcatacgtcgtgtctccactgtagaattggagttccacggacgccttaatgttttccgcagtttcattcaaaactaaattatagctaaattctgcggtcacatttggcgcgtcttctcctcttgtagccagcccattaaaaaacggcatctgcgagacttccgtgccgggttcatattccactacagcggtaatgcccgtttcagaaatggtatctgtcagactggttgccagtgccattggcgacagaagcgacaggagcactgcaagcaccaaaaccgttggtattccaatataacccctttttttcttcagcatcattttgaatcctcccattttcatttccctatcggggactggatgatgggttctttgccgctggtcgtgtactttgctcatagcaggcgcttaaatcattcccattgggctcaccccttctatgtgttttatgcacgcacatttcaagaatagcttcctgttggatctctttgtctctatatcagtctggaggatcaaaatattacacttcatctataattttttacgtaggccaggtctgttattgaaatttaaggagggcagcaaacctggattgcccttcttcctttattatagattgtaaactgcgtctctttggggcctaaccgccttccgacgcaaaaactttcctcctaacagcaggagcgccgcccaaatgggcggcgctcctgtttactttataaatgctcgcccttagcgggggttcttgatggcggcctgtccagcggcccacctgtaggggcgattttttcagaggaaatattgcttaaagtatcactccgaaccgtttcctctatcgacacggaagctttattttttctgcctttaatgctacattcaacagcattgtgctcccctgacagcaggtttagctcccaccgaaaatggtcgttcgtgattggaataactcggtctaccactttgtccagtagcatctcatccagcttgggctgtgtaaaatcaatgaggcagttcagcgtgtctctgatcttttcaacattcaatacaggttgcttttgaacaggtatggtagttctttgactctctattgcttgaagctgctcggcaatctcagacttttggctcataaattcttcttttgagagttctccatccgctctcatttcgattagattttgcagccgagttttcagcttttgagcacgtgcctctagtctcttatgctcttgatgctcctcttgatgtgattccttcccacactgagcaagtatcttgcatacctctatgactgcggcccggcggtctatccatacattttccagaaccgtctttgccataagatccagtttccaatcgcagatagagcggatttggcaggtgtgctcatctgtcaatccattgtccatcatatattgcaaagacgccccatttcgatggctgtagcattggtatccgtagacctctttcccgtcccttttattcgttctccagtgaaaccgctggaatgagcacccacatgagcaccgcagctttttagaccataaaaatttcgatgggttacgaccgaacttacgtgtacctccacctaactgcggcatagactgaattctactttcacgaatttccgcgcaacgattccaatcctcctctgagataatcgctgggaagtcgcctttgataagcgtgtgctgactggtatcatggtttgtgatgcgccgatgctccaagaaatccaccgtcacagatttattgtaaccgatgtagcccttatatgttgcattttttagaatgcgccccaccttgctacaatcccactttacttcaccacgtccgttctggcaaccacgtctcgtcaattcattgactatcgccttttcgccatatccatccaagtacatggaataaatcagtctaatgatttctgcctgtggctcattgatgacgtaggtacttcctacccggtcatatcctataatattccctgtaccatacaagaccccattttgacggctgatggcctgcccggccagcactcgttcggagattttgcgactctcctcctgggccagcgtcgccatgatggtgaggcgaagctccccgtctccatccagagtccaaatattatcctctacaaaatatacttctatgtcgagcttctttagttcacgtacagataccagcgcatcaacggtattgcgtgcaaagcgacacacttcacgggtcacgattaggtcaaatttcccttgccttgcgtcctccagcatcttcatgaaagcagggcgcttttttgcttgcgtgcctgtaattccttcatcaatatatcgatccaccactgtccaattgggatgatagcgctcctggtcatcgtaccattgcatctgatttttcagggctgcaagctgggcctcatgttccgtggagacccgcccatagaaaaccatttttcgcggccggttgcggtctagcgtcttgaatactgatttcatatcagtcacctccaatgcaaagaataatcttctcttggagatttgttaaggatgccgatctgcctctgcgattcgcagggcttccttatagacgctacgcgggatctcgcctttttcatataaaacgtgaattaagcaaactgccattttatggtgaaaacgcgtctgttccaacgaggcacctcccataaattcctatatcaataaaacagccgcgccaggactgtcgggccgttataacacgcggcgtactctggcgcggctgtctccgtgcttgtttatatcaattcaccgtatttgccacgcgcccccagtgacagggatattgcaggccgcccttggcagggctgtcaaaactccgcagcgtcgctctgggcgtgcgccgcagggttccccctctgacgtgggaggtcgttacgaaagtctcattatgcccccacgctgtcgtcgcgcccggtgtgccatgccgggtctaaggactgcgtagatcgctcggccagcttgtccatcacctcccaaagctggctgtcatggcggcgctccttacgtcgctgttcacgcggggttgtacctgcaataccgtgtatttacttgtagaaggaaatgaggaaagtatgtccttcactaagcacgtaaaaacaccccatttgttaagtcatttcgagcatcttttcgactttttttcttgcagcgcgaagggcaagagatattccggcctttgagaccccttcaatcgctgcaatttcagtaacacttttgccttcggcgtagtgcatccacaggcggcggaactgtgtcgtgctcaaacagcttttgatctttgccatgagcacagcacagtttgcctcctggcctgcctgctcaatatctctcagcagtaactcctctgcggatggctccatagaatctatccgctcatccagtggcaggcagttatcatagaaaccgcgtccggccttatccatctgatggtagttccggtcagaccattccttccacttcagaaagtccgcctcagaggagaagtctgcacgggtcaagtaaatatgtacgtctgtcacgctcttgcacacgatggaatcagggtgccttttattcaatgcgtagtcgctttttcggtcaaacatggtagctccctccaaacaatttatatggctcagataaattgatttgggaggagagcggcacccaggggtgcctgattgcctacaatttcttcctcacatcacaagacgcttgttctctccaaacacaaataaggtcggtgataaagtgtccttcatcgctgaccttgctgtgaagcacaatacccccatttatttactttaggagagcacaaaaatatttcaggtatctatgctctttgatgtactgttttgcaaataattcatttgtattacttcattttatgctgaaataataaccattagaatatttgtaatgcaaatactctaatggagggcgttgccgtgaaagagaagaaatcgcttcacgtcgaaatgggtcagcgtatcaggaaccgacgtgaggaattgaagtggtcacgtgaaacgttgtctgaaaaaacagatgtcagcgcccgattcttagcctgtgtagagaatgggcaaagcggcctttcccttgaatcacttggaaggatgtcctgtgcactgggcgtctctactgatttcctcctatttggtagcggaactgcaccaattccaaacgacttagcagatgctcttgcatctattcctccagactatcacgacctgttagtcaagcaggtacgtctcttttccgatattatcaaatgatggatttgcatttcagtcaactattcagtacaataaggatactattaccacaaagaaggaggggggcctatgaatcaagctgatgaggcatgggtacaggaactctatagatataacgcacccaaactgtataaagtagttcttcggcgtttagaggatgcagaggcggcacaggatattgtgcaggaggcatttctggcactaattgagaaaattgagcttgtgaagtgtcaccccaatcctgttgggtggctgatgaaggcagtccactttttgattctacaaacaattagtactaatcagaaccgtgtggatcacgaagtcgaaataattgaccagctagaacatctgactgctccgcccgtccaaattctttccctccgggacatgctcccacccggccttacccaacgagaacaagatctccttgtttggtttttcgaggatgggttgacctacgaagaactatctgcccggctcaaaattcctatcttaacctgccggactcaaatgtttcgtgcaaaaaagcactataaaaaactatcagaaaaagaaaaagatttttcagaattgatgtaatgttttgactcttttttctggtatttctatgaaggaggtgtcacgatgcctgagaagaaacgtactccgcatcaatcaagagaggaaatgaggggcgtctctcaatccaaatggcatctccatgataaatcagcagaggaattgttgactgagttagaggccaaactggacagcatgaccgaccagacctacgatgaagagctggttgatgcttatttggaagccctggatgaaaaggcccctctcccaaaacagtttgatgttgaatcatcatggaatcagttccgttccaagcactcaattctgtttgatgcagatgatattttacctaatccaaagcactctaggtccttttctcacaagttccgttttcgcaaagccattccccaacttgtcgccgcagccgccattgtcggggttctcggtatgttcggtgcccaggccgcaggtatcgacgtgtttggtgcactcggtcgttggaccgaggaaacctttcactttgttgctccaaaagcttctgcggctcccacttaccacacagtctcaaatggagatggattctacgagctggaacaatactccacgcttcaggatgcctttgatgcttactccatttctgatccgttagccccgtcttggatacccgaggggtacacactggactatgtggaagtcagtccctcagacacagaaatcatatttagtgcgtcttatagtaaggagcagaacaccctttcttttctgtattcctatcggaaggatggtacctttacctcatccacctttgaaaaggacggctcctctgtcgttgagtatattcaaaatggtattactcactatattatgtcaaatctgagtgtgcagttgtctgcttgggtaaatggtaactgtgaatgctccattacgggaccaataagtgaaaaagaaatgatcgcaattattgactccatctatgcttaggggaggaacagtcaactatgaaaaaatctctgcgttgcatctgtgcggcaatttttatgctggccttctgcacaggttttgttatccatgcttcggcggttgagcgggcaagcctctatcttacaaggtattcggccacagtgtccgcaagtaacaacggagctattgaaatgtcgatttttgtcgttgcaaataaaagtgtatcagagctgggtgccagctatattttgttagaggagtccgacgatggcggaaagacttggagcacggccagagaatatgaaggccaaagctggatgaccgccgaaaatcgctccacctacagcagaaccctctcatatccggggaccatcgggcaccaatatcgtgtgacagccgaagtttttgccaaagatgcaaatggcggtgacagtcgtaccactcccacctcccctgtagttactgcgaaaagatagctcaaaaatattggcggcattaagccgccaatatttttattttggtgaaatattttaggaagcatttctggtattaaaatagagggagctttaatgagcgaccgctggaatgcaagagcatgatggaagaatgggggtatacaggaaagcattaaatatggttagcaaaccgaaaataattaggccttagtatggtgattattatgaaaaagtgtatcatcgcatctatcctcgctttaatgctatctttaacaacatttgcccaagcgaccgctttaccagaaactaagataaatgattgggctgtccctgatgtcggaagggcagcgcgactcggacttctaacagatacccttggaactgattacacgagggacattacacgcctccaattttcggaactcgttgtcaactgtgtggaaaaggccacaggtgacaccattgatggaagttccgtaaaattcacagatactacaagtatcgcagcgcagaagtcggctgtagtcggaatcgttaaaggaactggagatggaacaagcttctctccaaaccgcttaattaccagagaagaagttgcaacaatgctctatcgtgcaatccaatacacaaatccaaataataatctagacactgcttctcttacaaagttttccgacaatgcacaagtatctaactgggctaaggatgctatgagttccatggttggctgtggaattattaacggcacttctgacaacactcttgcacctaaagccaatgtgagcattgagcaggctgcaatacttatttaccgcctatatggacagtccattctaaaggatataacccctctggccgaggcatttgtatctgaccagaaagccataatcacaaaactccaaggggcttatactagtaccccgagtacattcagtgattcacgtatcgattctattcagatggcagaagtgttccaagaaaatggaaccacctatattctgtattcactaaaatatagtgtaaaagccgacaatcctgaggcagttattgtgtttgaagatacattgaaggacggctggttggttataaacgcggttaccacgtatgttgtccaaatggatggcggcaaattcacatctttaggcggatacacaaccgagttttcagctgacggaaacaaagaaatgtataaaattgactttgagaactggctggcggaaaacattcttaattgaccatactcaaagcaggcattcagcagatgcttttgaccttgtcatcatgaacctaggttacagcaaaccatagacacagaaaatgtcacgagattcagggggcaggagacgctgtgtaaaggggggatagtgttctgaatagatactgctactctgccggaaacactcaatttacagaaggaggtatacttatgaagaggctactttgttgcattatggcccttacaatgattgggtcagcaaccgcttttgcggctgaacctgttgacaattccgccattgcagagaaggccctgtctgaggtcaccgctctctatgaagatctctataccatcaccaacgcggaagctgaagtccaaaattcaacctatgatgatatgggcaatatcattgttgacgttgttgtatcctttgaccgtacactcaaggctacctgtgctgaggatatgccgtatatccagggccttgagattgcattgacggagttgacagatccagatgaaatcagcgcagccagtgcctatattgatgcgaaaaaagcggatctggaagacaactatatcggggtagctcaggatacttacattgagcttcaagtaacagtccctatagcaacagcccgctcaaatgcagcacaggccatcgggattgataacatcgaatatgtcggtatgaatgagaatgttcctgcaaaggaacttgctcctgacagcaatcaggctatgatggaatccggccaagccgctattctgaatattaccgagagaatggctactcctagtactcgggcctcaaccatcaactctgtaatcaaaaattatgatcgtgtccgcgcacgtgactatgcacgcgactggtcatgcacgaacggttccttgtatgatcatgctacatgccacaatccagagtatacattttatgcgtcaaatgattgcacaaattttgtctctcaatgcctcgtttatggtgggcttcctacagacagtaaatggaagccatatactgagccctggaaaacaacaggcaatgctgggaatggcatccgccagtatttgaccaacaatggccttttcttccacagtaccaacgaaaaagaagcctttgccggaagcatcattaactggctgaatagtgatggtacgaacgccggccatgtcggtcttgtggatcagaatgataccgctacgatgaccttctgcgctcatactcgttgccgtagaagttgtccttggactggagagaaggttgatttttacattccctattgggattcctatgaaggtgactggactaagtgacgaatccgccaattcgatgtatcatttcgacatttctaattgatagtggcaagcaatgcctgtgttaatacacgcgcccgtctgcttgttgtgggcagcacccccaagcccccttgaacagctctgtaccggagctggctacgcgtcctgcggacgctaaagagcacggtcagctcaccgctggctgtgctctttttcctgcgcgatgccgcgcccggtgtcctgcaaaacgcggtccacattggccttgacggtcagcagctcccgcgcctcgtcgcgggccttgcgcagctctgcgtaggcctcctttttctccgccagcagcgcggcgtactcggcctgcaaggctttcatctttggcagcttcttgacgttcagctgatcaaatgcctgctttgccgcctgatggagcaggatgtcggcctcgtgctcagaacggaactttggggagtagccagccttacggtaggcggcataggtgtcgcgggtcttggcgtagttgacgatgtgggttcgcagcacggcgatctccgccatacgcttctccgccgccttgattttctcggacagctcgttgcgccgtgccgtggctgccaccgtcttttccgccagcaccttgtaatccagaaggccatgatcgttgagatagttcagggtctgcgccatctgtttcaggttgaatttgctggcccaccgcgcatatccggcccccttaccggcgcggagcttggcctgaatgtccaccagcagattgaccttcgggacagccggagcaggggcggctctccgggccgggacatgcttgtgcttcccagtgagcgcggcacacaggtcggcttccccatagccgtctcccagggttttcaggcagacaacatttttccagccgggtgctcggaacgcaatatctttgccccgccgtttggcggaaaagcccgcctcttgcagcagcttcaaaagggcctccaggtcctccggcccgcgctccatggccctgtcaatggcctgccgcagcagctcccggtgggagggcttggcctgggtgcccagccacttgtcgtaggtctggcccttgggttttgggtcctccacaatggacaggccgttttcaatgcacagggtatcactcaaccgccgcacggcgcgagtgctgccccaaaagttgcggaacttgcgggtgcagtccagcgaggtggagttccaaatgatgtgattatggacgtgcgcacgatctatgtgggtgcagacgataaaggcatgatcgtccttggtaaagcgtctggcaaactccacgccgatgcggttggcctcctccggcgtgacctctccaggcacaaacgcctgccggacatggtaggcgatcacatcgtccgcgccccgccgcctgccggtcctggcgaggtattgctgcttgctgaacagaaactccgcgtccgcgatagggccgttgcagccatgggccgtaatgagcctgccccggtcggttttgtccgggttctcaacatagtccagaatatcgcggatagcgttgcccacgctccggcccttgccggtgtgcaggggcatgatgcgggtggttgccaaaagaagtcctcctcgtataataagtttcaaagttaatagtttcaggtatcagcaggctttgaggtgcccgtgatacaatagctgtaggacagcagggtcaagttctgagtcctccggttgagccgtaaggctacttcactgaaagtctgttcccctgaaccggaagttagctgcaaactcattggctgtttgcctgggacaagaccgccctttcagcagtgagggctatcgcattggtctgcccaggaatgattctgataagcgagggtgccagatgctccggttatcatgggtatctcaaagcctgctggcctgaaatctccatgcggggaggtgaaaattgtgaatccactattcgttggcattgatgtgagcagcaagaacaatgtggcctacctgatgaaaccggacggcagcaaacactccagcttctccgtgcagaataaccttggcggtgctaaactgttatcagagagaatcgtatcggcacttggctccatgcagcttgagcgtgtggtgattggcctggaggccacctccatctacggggacagcctagtctatgctcttcgtgaggatggccgcttggggcggtttcagaggaaaatccatgttctaaatccaaagcaggtgcggaaattcaaggaagcctattctgacctgccaaagaacgactgggtggacgcctttgtgattgccgaccatctccgtttcggcagaatcaacagggaggtctacatggacgattaccgctacaaagccctgcaaacccttaccagagccagatttgatgtcatccaaaacttgacccgggagaagcagcggttcgccaactacttattcctcaaatgctccggcatggcccaggacaaagacattcagaacaccagcgccaccaccatcgcactcatggaacactttgaaaccgtggatgacttggcgaatgccgacctggaggaactgactgcctttattactgaaacaggccgtggcaaatttgctgacccggatgctaccgccaaggcagttcgggctgcagccaaaggctcctatcggctgcccaaaacagtaaacgacactgtaaaccaagcaatggctgtttctattgcctccatgcgcgccttgaaagggcaggtcaaagtattagataaggccattgaacagcagtttgaaatcattccgaacactttgacctccatccccggtattggcaaggtctactccgccggtatcattgctgagattggtgatatccaccgttttgattcccaagcctcggttgccaaatacgccggccttgtctggaacaggagccagtctggcgacttcgaggccgaacactccagaatgattaaatccggcaaccgctatctccgctactacctgctggaagccgccaactccgtgagaagatgcgactccgagttccggcgttactatgacctcaaattcaaagaggtcaacaagtaccagcataaacgcgcactcgctttaactgccagaaaactggtccggttggtctttcggctgctaaaggacaaccgcctgtatatcccgccggagggctgagagcgcagcttgccactctgactcataggccctgtttcaaaatttctcagggacagggctttggttggtgttgcctttttgctgtctacacagtgctttttactctgtttcgcttaaaattttcttgcatcacctacttgacttcataccattggactttcctggcgcgtacatataagaacagccccggcgcttcttgagcgtcggggccgtttttgtttgacttatccgtaaatccagtcctgaatggtatagcgcagggcctggagctttcccagcagccacgccgcagccataggcagtcccatgggagagacgaggaaggcaatcaccaggagaatgatgccgttttgaactgagtaggtgacgagcaccgccacacccaggatcgccacaatggtccccgcgaggccgaatataaaggcggtgcagtagagcaggccggagcaaatccagaccagcagggccagggccgcaatcaggggggccgcgaatatctttaacagtaacctcatatctcattcctccttggcgtctttttacactctcatcttaccataggctggggccagccacaacgatgcggaaattcgccgaaaatttcggcgaatttttttcggcctattccagcttggaaagctgggagagcacatgccccgccgctgaccacaggcgttcatacccctgccgcaaatcctccaggtccgcgtcataaaagcgcccggtctcatggacgcggcgggtgagctggttcaaattgttgctggaccggcgcagcaggctcaccagctccttcagctccggcaaatccagttggagcacatagccgtctatcgccatcttgcgcaggtatgcgctgagattgtccgtcccgaactgggccattttctgccggatcagctccatctcctggggtgagacccaaaagaggaccggcacatttctggtgcgcttcgccatgcttaccgctcctgttccctgacctttttcttgtccgtgtgccccggctcggctttcgtctcactcagctttttccgcacggagggcttgcgcagccgcagggattgggcgcggtcctcgtctttggtaatcagggcatagacgcctttgcgcccctccagtgtggagattgacagggagcggaagggcagcatagagacaagccggttctggttcttactgttggcacgggccaggaagtccggggagacctggaccatgaagtgggtgccgctggggctgttgggcccccgcgctgcctggaacgcggagaggatacgggcggcctcggcccgaatgtcgtctttggtgaggggttgggtcagcagatactcatgccgcaccatatccacaaacaggtcgatgataccgggatggctgcggtccacgacaaactctttgttgcggtcattcccccaagcatccaggtcctcaaagacgggaaccgtcctggcccacgccttgttgccttgggaaatccgcccgtcccactctttatgccggaccgtattggcaaggacgtgaagcacccgctcatagccgaactgctccaccacctgggagacggcttcccggcccaggcagttgtcccggtagtgctccgtaatcgcggactctatggcctccttgcaggcaatgtcggccttgcgggaggcccggtattgctccagctccccgtgctcatgggcatagcctccgggatagcggtacacaggcagctcccgctgggcttggagggcggcgtaggcccggttcgaaatacagtccagcatagggtccaagtcagaacttttccgttctgtccactccccatagatggcctccatgggcgaggacacagccagcagcgcggcggcctgggcttggggcatatccatcagctccgccgccgccaggatgtcctcccgcaccgcatattcataggcgtggttcagaatttcctccggcggctggcccatcagccagtcccggtacttggcctgctcggcggtcagtttttcatagagctgtgtgttcatttcctctggtgtcatgttcatcgtacctcctcctgatgttttttctccgctgtcctgggcggcgcgggccgtttcaggccctccagcacggaggggcgtgagctcttgaccatgccccgctcccgggacgcgggcttgcgctgtgcgcccatgtcaagctgggcgttcagttcggccagccgggcgctcttggccgccagctccgcctcctgggggaagggcttacccagctcctttttcgccgccgcaagctgctcccgcaggttgctcaaccgcacctgtacgccctccatgcggctgtgtatatcggcaagggtattatcaatacggagcaggttgcccctggcatccgggcccagtttggtccggtgggacatttccccctttaaggttagaatgaagtcgctgccgaaattctccacggacaggaacatggtaaagccccggtaactgccgatctctgtcagctccggggtcttgacctccttgcaggcccccaaaagggccgcacccgcgttgtccttgtccgtcagggtgtcgccccggaccaccatcccggcgaagcccttttccacttctaccgccttgccgtcctcaccgcccctggtgacgatgggatggggatgggcggccagggtctccatgtctttctgaaatccggcgataaagccctcgcactccctgatctgctccgggaaatagcgcagcacattgtcctccatctggaactgcttgctctggtggtccgctttcaggatacgcaggcgggacacatcaatgtccaggtccatcttctcccggatgaggggatcgcccgcgcaaatggccttgatctccgcataggaaagggcggtctcgtccacgtcctcgcaggaacgcaccggggatttggaggtcatgatctgagagatgaacttctgcttgttctccaccgtctgccacaagtagggatcgaaggtgccctcggtgacatagcggtagatatgcacttcctggttccggttgccctgccggacgatgcgccctttgcgctgctccaggtctccgggccgccaggggcagtccaggtcgtgcagggcgatgagcctatcctggacgttcatgcccgcgcccattttgaatgtgctgcccatgagcacccgcacctgtccgcgccggaccttggaaaacagctcctttttgtgggcgtcggtgttggcatcgtggataaaggcgatctcctgggcggggatacccccggcgatcagcttgtcccggatgtcctcatagacggaaaagggcgcgtccagcttcacgtcgttcaggctgtccaccagcgcgtggaggtctgcgcctcccgcgattttatctcccaccgccatcgcgctcctgtcccgctgagcggcggctttggacttgggcgtggaaatatcgcagaacacaagctgggtcagcttgtccgcctgcccctcccgccagatgcggagaatgttgttcacacacatgttcaccttgctgtcggggttatccgggagcatgggattgataagccgctgatccaggcccagcttgcgcccgtccgacgtgatcttgagcatattgtcgatatgtgggtcaatccccgcatgtaccttcgaggcccgttcagaaaggtcctgcaccatggctttttgatgctcggaaggttcggccttctccacatggtagattgccttgggggtggggaggttgagctggtcggcggtcttgatgtccgccgtctccttgaacatggacatgagctccggcaagttgaagaagtgggcgaaccgggtccgtgcccggtagccggtgccctcgggaacgaatttgtcaagatgatttctttaatttttctaaacttaacaaaccggctgaaaagaaatcttcctgaacctcgtgtctgcatatatccttaaataccttttctatcggctttttggcggtttccgactgctttacgcacacaataaaagtggtctttccaatttgcaccgaataacttgaatttttgttttccatatcgtttcacttcctttcctttcaaaaaatatgggacactcgcttgccaagtgtcccgattactgcccgaaaatacattcccaacagtccaagaagtcattaagtcgggagtgtagtcgaagtgattatctttccatatcacgcttatttcttcgtgccttgatacgctcttgtctttctttttcccttgcttctttttcggctcgttgttgttcttccttaaaagaaaaaagttgccttactttttcggtgaaaagtttggcaacttcggggaagtgttccaatgcttcaagaaacggtttgcatttttctttcagctcgttgtatttggttttcattctttcaagtgcgtttgcactgtcaaaatacttctgcctgtaataatttgcattttgctctaatgacttgatttcggcacgacttgtaatgccctctttggcaagtgcagtcagttgtgagtagtcctctttggatattgccatcttgcctgtaaaggttttctgtcccataccgtcaatctcgtttaaggtctttgagatatgacgggcaggctcatatttcacttgttctttctgaatacgctgttgcagtttctccaagcgttccttgtcctgcttgatttgatattgcagagaggtcaagtgttctgctgtacttccgtattcgccacgctgaaaccccttaaatccctgctcggtcatataattgaacaattcatcttgaagtatgctgtatgaggctctgaacatcggctttccgttctttcgcaataacggattacctttctcatcggttagcggaatatccgatttccatttctttgaatggctaatctgattgactacttccttaaccgttcctcgcagtttttcatctttgcaacgcttactccataagatttctttttcgactacgggcaataccatagcatgcagatgataatggtaaacctcttttccgagttcctcggtagcagctacattgatttcgtcagcgtgcattactgccgatataacattatccgcaccgaatttttcctcgatgaaatgataggcttcttcataaaactgctttgcatactcataaccaccgttacgctcgaagtacatcgtattcacatcaatcacaatctcgttaaagagtgtagcgtcttttctcaacccacggagcgacaccagcccgttggtttccatctgcttcaactgttccatataggtcggagcaaaaggctttttgaaatgcacattaaaaggtatgcgttcctcaatgacattcatattttcataggtttcatttttgcgctcgttgtgtctttctgccttgctgacatcggaagcggtgtactttttaacccttgcacagctcatatccgctttgttgtttttcgccattttcgttctcctttctcggcagggcgaagccattacacaacattctttgaatgtgtgtaacccactatgacactttcagacttcgtctgcaaagatgtcgtgggcaagggtgttcccccttgacctcctttgatacctcaatcacaaaaacagactgtcccaccgacaggcattctgtttttattctctcggtatatcgctcatcggcaaagaccaataccaaagaaaacctttcttcttggagataactcctgcgtttttctttgcctttttgatggtcgatttcttgaaccctgcggcttcaagtttttcttcacaatccgaagaaagcatttctccgccctgcaacatttcaatgagaaatgattttgctttcatctctttttcattcggtctgcctatttgtggggcaagagataaaaacgcttcttcggctgtcatttccatttcggaaatgaagttcacacctttctcggcaacctcaaaaagaattgccgaacctgtcggagcaagatttgatttcacttgcaccaaatatctttccgcaggtgcttccttgttcggtgtgcgtgtgattgcaagaatgcttcttgcagcacccgcaatgtcaatcgagccgttggtgcggtagagtggattattatctttcatcttgttcatatgagcgataatgacaatcgcacaacccgtatcttttgcaaccgctatcagatggttaaactccgctcgtgtttcgttggcattattcatagagcaattctctccgatatacgaactcaacgggtcaagaattagaagctttgcattgtacttttcaatcgcttcacgaatgcggttatctccgaaagataaagtcttttcatcttccttgatgaagataagattttctccgtctccgccggcagaattgaagcggggtactacggtatcgtctgcgtcatcttccgttgtctgatagatgatagtcataggctcattttcttccgtttcggtaaaggggataggttcgccctttgagagcagggcggcgatggaaagcattaacttgcttttcccatcgcccggatctccctgcaatagcgtaactttgccaaacggaatatacggataccacagccactttacttctttcggctcgatttcacttgccttgatgatttcaagaggtacgctgaaattcatttcgttttcatttagtttcattttttcttgttctccttttctctgaaaatataaaaaccacagattgatactaaaaccttggttgtgtttctttttgaaaggcttaaatcaaggaaaaatccttgttttaagcctttcaaaaagaaacacaaggtctttgtactaacctgtggttatgtataaaattgtagattttagggtaacaaaaaacaccgtatttctacgatgtttttgcttaaatacttgtttttagttacagacaaacctgaagttaactatttatcaattcctgcaattcgtttacaaaacggcaaatgtgaaatccgtcacatactgcgtgatgaacttgaattgccaaaggaagtataattttgttatcttctttataatatttccccatagtaaaaataggaatcaaataatcatatcctttctgcaaattcagattaaagccatcgaaggttgaccacggtatcatagatacattaaaaatgttttccggagcatttggctttccttccattctatgattgtttccataccgttgcgtatcactttcataatctgctaaaaatgatttaaagtcagacttacactcagtccaaaggctggaaaatgtttcagtatcattgtgaaatattgtatagcttggtatcatctcatcatatatccccaattcaccatcttgattgattgccgtcctaaactctgaatggcggtttacaatcattgcaatataataaagcattgcaggatatagtttcattcccttttcctttatttgtgtgatatccactttaacggtcatgctgtatgtacaaggtacacttgcaaagtagtggtcaaaatactcttttctgttccaactatttttatcaattttttcaaataccatctaagttccctctcaaattcaagtttatcgctctaatgaacaaagatattataccacatttttgtgaatttttcaacttgcccacttcgactgcactcccgacttaataacttcttgaacacttgccgaaaaagaaaaactgccatcacttgacagcagttctctttcggatagtattccgttatgaatacacaatatcgtttaatacgatttcatctacgcaagctctgatattgttcatcaatcctatccatctcatcatatccacagcctttaattgctcggtaacgccttgctttcttgccatttcctttatgagatattcagccatatcacaagccgaagtgtcaatctcggcaaggtgttcatataactttccacttgtcatcagagtgtaatataaaactcgcttgtgttctttcaaatatcgctctcgcattcttccgtaccttgaaagcaaaggtttttcttctgcggttaagcaggggtagtaatagtccccgataagttcatatcggatacccgttctttcgtctgtgataaatctttgcattgcagcttctccttttcttttttatggtggtaaaattccaatgttttcttattgtgatttaccctttgacattcttcggagcagaatttctgttggctgtgtgtaggccaataggaattgccgcacacagcacatacacgctgtcggtaatagtgatttcctcgttctgcttctcggtctgttttctttttgtcttgccttgcttgatagcagcactctttggaacagaacacctgtcggttgcttgtcgggataaactctttgttgcaatgagggcaaacctttgtcttaacgatttcgccaccgttttcagcgattttctgtgcctttcgcttttctcggtaggctttttcacgcttgcgctgtcttgccaagcgttgctgttcctcctgctctttctgtgtttctatctcggcaagttcttcttcggtataggcaatatccacttgaccgacatagttaaaataaatatcgaccttttgtgttcgtgcttttcccacaccctctgcttcataaaccactatcttatcaacaagttcattaaacattgtatcggagatttccgtaggatttttacacttgcgtatcagcgaaatgaaatgcttaatatcaacggaacttactttttcttcggcaagttctgttttcatcgtttccattttcgtttccaactctgcctgctcgtcatcatactgtttcatcagttgcttatactgtctttcgggcagtaatcccgacataagattttcatacaagccacgaacaagggtagagagttcgtcatagcgtttctgacagcgttgcagttccgattgattgtgtttcggcttttcctcctgtttttcattccaaagagattgcagttccaaagcaaatgcttgttcatcattcagaacaaaccttgaaaagcgtttgacagatgataatatcaaggcttcaacattatcggtactaatcgaatgactggtacaactgttcactctgcttgcatacccaccgcaacggtaagaatactgcacagaaccgtcttttttgctgtaatgtgtctgcaaagtcattcttcttccgcaatcggcacagtacaaatatccgcttaaacggttgctgtgcgttccccaagccgaggcacgatttactctgcttctgcgtttttgaacgctgtcccaaagttcctgcgatatgataggctcgtgtgtattcggaaatacatactgttcttcttcgtctgtgctttttctcttgtgaagtttgaaatttgtgcttaccgactttcgcaaaacggtgtgaccgagatattcctgcctgcctaaaatatttcttatcgttgacattgcccaaagataagggtttgtgaacttgttgccgttgtactgttcggggtggtattcctttgcgtatgccgcaggggttaaaactttttcttcggtcagtatttctgcgattgcccttgtacttttgccatcattggcaagagtaaagatacgctttaccacttccgaagccacagggtcaaccacaagcgtttgtttgtcgctcggcagtcggttatacccataagggatagaaccgctacaacgctttccgtctttcatacgggcatcgaatatagccttgattttgttgctcgtgtctttggcataccattcgttcataatattcaaaaacggagcaaagtcattatccgaagcgttgttactgtcaatactgttgttaattgcaaggaaacggacatttttctgtggaaacagaacttccgtataaaaacctacttgcagataatttcgccccaatcggctcatatccttaacaatcaaggtttctacatttcctgcttcaacttcttttatcagagattgaaagccagggcgattgaaatttacacccgaaaatccgtcatcggtaaaatggcgaatgttctcaaaaccattcctacgggcataatcttcgaggtatttcttttgattggtaatagaattactctcgccagtaaggtcatcatctcttgacaaacgctcgtaaagtgctgtaattcttgaagtccttgacattttcttatcctcctttccgtatgtattttttcaatttaggacagttaatttttttgtcctattaaagtatagccctccggggccagctcaatggccgtcaccgtctccccgaaaatggaggcccagttgtcaaagtggctcaagtgggtcttttccagaaggtctacctggagataccgctgcatggtgtaaagctcggtcatgctgttggaaaccggggtgccggtagcgaacaccacgcccttgccgcctgtgatctcgttgatgtaccggcatttcagcagcatatcgctggacttctgtgcatcgctggtggagaggcccgccacgttgcgcattttggtgtagaggaacaggtttttatagctgtgcgcctcgtctacaaagaggcggtccacgccaagctgctcaaaggtcacaacgctgtccttccgggcggtggtgtggagcttttccaggcgtacagtcagggactttttcatccgctccagctgcttgatggtgtaccgctccgcaccgctggcctccagctccgcgatgccgtcctcaatctccgcgatctgctcctcaatcagccgttcccggcgcgccatggaaaccggcagacgctcgaactgggagtgccccataatcacggcgtcgtagtcacctgtggcaattttggcgcagaaccgcttgcggttgcgggcctcaaaatcttttttggtggtgacgaggatattggcggcgggatagaggcgcagaaactcggaggcccactgttccaccagatggttgggcacggcaaagagagacttgcggcacaggcccaggcgcttgctctccatggcggcggccaccatttcaaaggtcttgcccgcgcccacctcatgggccagaagggtgttctttccgtagagaatgtgggcaatcgcgttgcgctgatgctcccgcagggtgatctccgggttcatgccggtaaatacgatgtgtttcccatcgtactcgcggggccgaatggcgttgaagcgttcattgtaggagcgtaccagctcctgacggcgctggggttccttccaaatccagtccttgaaagcgtccttgagggcctgctgtttctgctgggccagggtggtctctttctggttgagcacccggcgctcggtgtcgccgtcccggatggtatcgtaaatgcggacatcccgcaggttcagggtgtcctccaggatgcggtaggcgctggcccgctctgtgccgaagttcatgtaggccgccacatcgtcgtaggggatggcggtcttgttggtgacagaccactccactgtaaactgggaatacaggacccgtattctcccgcgcagataccccggcgtctgcaagatctcatacatgaactgctggatatacttctggtcgatccacgtcgcgcccaggcgcaggtcgatctcggaggcgtccaggtccttgggaagcgcctgccgcagcgcctccacattgtcctgatacatggggtccgcgtctgctgccctctgcgcctccaccagcttctgccggacgttgccggagaggtattcgtctgccgccgcgtactggggaccgcccgcgccgtccgtctcattggggacgcggaaaatgatgccccgcagctcggcggccagctccgcctcagtcttgccggtgagctgggccatgtagggcatgtctacccgcgccttttctgagatagagacggccagggcctcggaagcggtgtccacatgggtaacagcccggtggggctggatggtccgcttggtgaacatatccgccttgcgctggagattgccgtcctcgtccagcacttccaaagaagataacaggtagtaggagttatcgtctgaaaaggccagctcgttgccccggttgctgataaggccgaagcgggcggtgaaggcgtcatagagggtgttgagctttttctgctcggcctgaatggagagcgcgtccgcgtcgtccatttgcaggtcgatcaagcggttgacgcaatcccgcagttccaccatgccgatcacgcgggccgtggcggtggcgttcagccggggctttaccatgatgctgttctcccggaagtacacctcgccgtccaccacggtgtaggagtagttcttcacattggggtctgcggggatggcggcctccgatacgggttcttcctcatcgcccagttccggcacctccacttccgggatttggccgtggatgcgccccaccgcttcatggagctgctgggcaaggtccgcgccctcgatggggagcacggtatagtcctggtgcccatactgggtgctctccgaagcggcccgccccagtaccatctccgggtgcgctgtgaaatagtggttgatggtgaagccctccgccgtctcacgggtccgcacccagtccggcacaatgtcgatgaggtggtcccgcttttgcaggaagatgatgtcggagactacttccgtcccggcgttggccttgaacgcattgttgggcaggcggacagcccccagcagctcggcccgctgcgccagataccggcgtaccttctcgtccttggcgtccagggtataacgggaggtgagaaacgccacgatgccgcccggacgtacctggtccagcgccttggcaaagaaatagttatggatgtggaagcccagcttgttgtaggccgggtcattgaccgggtactgtccaaagggcacgttgccgactgccacatcaaaaaagctgtttggaaagtgtaccttttcaaacccgcgcacggcgatccgggcctctggatagaggagggacgcgatgcgcccggtgatgctgtccagctccacgccgtagagctgactgcccgccatggcctccggcagcaggccgaagaagttgccgacgccgcaggagggttccagaatattgcccttctggaagccgaaattacccagggcctcatagaccgccttgataacggttggactggtatagtgggcgttcagggtggaggaccgggcggcggcgtattcgctctcgtccagcagccccttcagctctgcatattctgtgtgccagtcctccttgtcctggtcaaagacttggggcagaccgccccagcccacatagcgggagaggacctcctgttccgcctccgttgcgccgcgcccctccagctcaatcgctttcagggtgcggatggcttccacattcctccggtacttctccttcggcccgccctcacccaaatggtcgtctgtgatgtggaagttgccagccggaggcatggagggacccggccctagccgctccggttcgccggtgcggatggtctgcaccacaacgtcatagggcaggtggtttttatcccctggatagacagcggtggtctgcgtggtgtacgccggttccgccgtctcccggacctccggctggaacagtcccgcgttgcgctcgtcctgccgcagccattcctcgaattgaccgcggctgaccatctgctggctccatgcgtaagggccggtatcaatgcggatttcctgctcgccaatgtggccgatggcgccgctgatctcctggtcgggcgcgggcagcaccacatggtcgcccacctgataagttggggtgcccgtcagatgcaccgcctcccgctgaaccggcgtgtgggaaaagccgtccagctcctgttgatacagggcgcggaggacggcggccagctctttccaggaggcggagacggtggcaagtatcttgtcatcgtcccagatgatctcggcttccatgccggtggtggtcgtccggtagtccgccgcctcgccggtcacaaggcccatggtctccacccggcccgagaactgggcggagagacgctgggagagcttggtgttgccctcgccgttccgcaaccaccgggaaacatagtccttgtcccggtctttcagcaggccggaggccagcacctcccgcaagtcctggtcgaaccgctctaaatcagcgggtaggaactcggtaattgcgccgttgcgctggtcctgcttcagcaaccgctcaaagttctctcgcgtctccagccggttgacgggataggccagcgtggggtccagaagctccacctgtccccgttccagggaggcgatcttgtactccctatcctccagatagacaaaatccccagcgccgtaggctgaggccagcgggtcgcggggcttgccgtcaatggtgattacccccggcaccgctccatcctccgggatggcctcctgtatctctgtccattcctcgtcagaaaccgcaaggtctacttcatgggttggctccccggccccgatgatgatggtatcgccgttgcgggacaccggctggcctgacaagtccggctgggccggttccgtcagggcggcataggtctcctccaacacggtctggtggagactgttgtgaaagccggtcaggtcataatagaggcgcataaaattggggtcctcaatagacagcaccgcccgtttgatggcctcctcaccctcaagcatggcgttttcccggtccgagttctgtacggcgttccggtatgcctgatctgaaagcaccttttcccgcacaatgggcagataatgctcgtaaatctcccggacggttggggacggccccagttctggcactttgacgatctccggcgcggacgcaggctgaaatacaccattgtccagatacgtctcaaacaggggccggaacatctcggccacgccgcgctccggcatgtcaggggtcgtgtaccagacatgctcctcgtccacatggtcgatcaccaaacgaatgaccgaatcgttttcatccgtgtgactgtctaaagcgtcccctggccggtaggtatggccgcccttggtggtataggtctccaacgcatctgtaccagtggcccgctccacatcagccatgacctgacgaataaaggggtcgctgcccagtttttccgggtccactaccttgccgtccacaatgccgcgctcggccagccgctcccgtatctccaccgggtcaatattttcaaagttgtcctgttcttgctcggtgaagaactcgtcccgctgaatgagctgggcgatccggcgctggaccttgggccacggcacatcgcccgcagcgccgtccgccgtgaccgggaacgcgggcaggctgtcgccatactcctgttgcagccatgcggcggtgtctttttcccgcccatgctccttcatgtagcggaccacggcccgcttgctctccatgtccccgttccagtcccgcagggccgcgtcaatgtccgcctgggtcagcgccccatggcggtccgtggtagggatttccggctggtgcgggacctccgggctgtcaggcgtccttgcctcgtccgcaccggcttcggcctcatgagcgggaatggcctgctccttgtcccgtgcgatctccttttccgccaacaggcagacctccccccaggtcaggcgggtaatagcggtagggttgagataattgccctcccacacatggaactggtccgggaaaccacgaaaaccgatggtggtcccatcgctggccgggtactgatgcaggacctcgccaaaccgcaggcgcagatagctgacccgcagatgttcctccgggtggtcggcaaagaacttggtcagggcctcccaggtggcgctcccatcttcatggcgcagaatttccgggagatacttttcgtggaagggcggcagggaggcaggcggcgggctgacggtctcagcggcgggctgcgtgatgagtgcgtccaaggtaagctgctccggctgcatgggaggcggatagggggcgcggggcaccgggggcggcagcggttccccgcgctgctgaaagccccgcacgatagcgtcccagcggcctttttccaccggagtgaaatagtcctgagcggatgccagctccttcagccgtgccgccgcccggctccatgggatgtgtatggacccgccgggctggtaacgcctgaactcgatgtctttcgtggtatagatcaccgtcccgtggcttccgtcctgataggtttggctgtgggagtaaaaggacccgtattcctgcttcaaaaaggctacggcggcctttgtgtccggcatccccaggaacagggcgtaaatccgcagcttgccgtccagattgccggacccccggcgcagctccgcgtcccactccgcgtcggagatggaaaaagcggagggcgtttccacgctctccgcttccgcgatagactgccgctgttcctgttccgaggggaacagggtcagttgttgttcctgtccggttagctgaataccagctcgttcaggatgatctcctccgcctgcgctttcagggtgttcatcaggcccgcccacttcattgggtctgctgctttcaacgcctccgtcacgcccgcctccttcgccatctgcggcatcatctcggacagacgccggtgggccgtctcgtcgatctcccgcaggtgcgggtacagcttcccctccagcaccagcttctgaaacaggatgggccggtgctccttcagatgctgcctgcgcatcctcccgtacttgcccagcggtgccgcctccggctcctccgtcagcttcaggtccgggatcagatagtccccgttctgtgtgtaagtcagctcgttctccatggttctggctcctttccgtgattttctcccgctcatagcgtttgatggtgacttcaatgtggcgcagcacctgttcgctgacctcgctgaccgccgtgcccagggcggagacggcggcgggggtattccagtcaaagacgctcagaaagtcctcatgcccgaaatactgctccgggtccagcccgcagcgggccatcagcgtataggtgatgctggtggaggcggcgcttcggaacgacgcccctacgttgtaatcatcatattcctccagaaacgaatcttcaatgatgccgagaatatcccgttggtggtcctcccaatagtcctttgccagccgatccgctacaagctccagctgatattccaaaccgttcgcgccggaaacctcatagcgggcctccaaagcccgcagtaccgtgtccatgtgctcgtcctgtaactgccagagataggggcggcgtgcattgtctccgccgcctgtgtccgccacgtcgaacacatagcgcaggctgggcttttcgccgctgctatccaccagggcgatgcccctggacccgcgccggacataccggcgcatccgtttgttccaaaagtcatactccgcgcaggccgtggcctccgggcgctgggcatagatcataagctgctcatggtaggggtatttatagaggcgggcggcggtggcgagaaaagccgtccactcctgatagcttccggtgatctgctcggcggtcctggccgccatctgctcataaaactgtgctctgtttgccatgctcaaaacctcccttcggatggtaaatagcacaggggacggctgtgcgccgccccctgccggtcagtccataaagtccgggataagttccaactgctcatagtccgcgtcgctcagttcccgcagcttttccagcgcgctgtccgtcagctcccgcagctccgtctcgtccggctccaggtatccccgcatctcctccaggttggcaatcaggccctccctggtgccggggtcgtaaatgctcatcagttccatttcctcataggtaaagtgcttcatggttatcgctccctttctgtgcttttttccgctgttttttcctctgctcctgtgctggtggtgcagttctaagctgtgccaccacagattttttcttttccgtctgctccttatggaccgcttgcgcaaggtctacaagggaaacctgctgaccggccttgacctgggcctccagctcggccacgctgggagtgttgttgaggatgccgtcgagctggttgtcgttctgctccaggctgtcctcggcggcccggagggggttgcgcccggagaaaaagccgggcagctcggaaaaggcgtactggtctacatagtggcaggataacacgccgccctgcttgagcaccacgatgtcgctgatgctcatgctggggctgtggtagtccgccgggtggtcctctttgaagcgatgccaaagctgatcgagctgctgaagggtgtcaccctggccggtgagcggggcggtgtagaccagatcatagttgcccttccggggggacgcgccctccgcccgaaggcgctccagagagatatcgcgcaggtccctcagctccggcccacggtgaagctgatagagggcgaagcaatccccctggtggtccagaaaggccgcctcccgcctctgctgttcctcctcacggagacggttctggatggcatcgtcaaaatccgggctggcctcccattcctcgcggggaacggcaaagaggccgtcgtggttatcaaagtccgtctcgtcaaagaccatctccgggttctcgccggggcggatgagatagacggtgaaatcgctgccatacataagctccgccgtatccagggagagcggaagcaggtcattctccgtataaccggcttcggtcagatgttccatgctcatggaggggtccggcatggggtaggtgtccagctccgtatcaaacagcaccgcgtcctcggcggcaaagtgctcgatcagcttttcgcggctggaaaccgcaggcggttccagttgggcctcctgcaacttttccaccagctccaagggaaccgcctccaccttctccggcctctctcccatggtgtcgaacacttcctcccgcacggcggccagggggtgcttgatgggagagagcgccacgtcctccgcgtcgattacgccgccgtcccgcagccgcatggtctccttgtcgtagagggtgtagtcgtagccctcgtcccgaagctggatatggagataagcggcgtcgtccagcagatacagggcctccagctctttggaatccgtctggtccagtgcccgcacctgccgggcggtcatgtctcccgcctccaactgatacagcagctcccggcatcggtctgttggaccgacataaatcacctcgcggggaatgtaactgtcgccgttccattcgccggcctggagatagccctggtcctgataggaggtggcgttggggttagcctccaagcggaaggtcaggccctggtcccggatgtcgctcaatttctccagccgatccagcattgccacagcggtgggcaatcctgtctgctctcctacacggtccagcgtattacggatgtcggcaaaatggcccgcccgcagctcctccatgatctccacaatcgcctgctccctggggtccagcgaataggggtgttgcagcatcccggcggcttccagctccgccatgtaatcgtagagggcggcggcaaactgttccggcgtgtccagcccctcgaaattcgccgaaattttcggcgcattttcctgttccagctcaatgccgcgctccttgcagacctcggcgaagtggcggtcaatctcaccgatgagctgattggctgtcttattgatggtcgccagacaggcgcgcagctcggacagttccttgtccttgctccaggacgcaaggtagccgaagctgttggccccggtctcaacgccgcaatactggcagaccacataggacacgctctccgcctccagctcctgggcggtccgcaccgccttgtcctcacgcacacccctctgattatggaggatggagtgggtgatctcatggacagcggcgcataccgtctggacctcgctcatacccgcccggatggaaatgctctgctcgtccagactgaaatagccgtccaggttctccgccatgggcttgatctccataggcaccggcgcggtccggcgcagggcctccataaacgcctcgtactgctctacatcgccggtcaggtcctgggccagctgtgggaggggcttgccgttggtctgagacacgtcgaacaccggcaccgggcggaaccgtggcacctgcacctcccgtttctctgtgataacctgaccgtcctcgtccagcaccggcgctttggtgtccgggtccagcttctgccgctccaccgttttgacgatgggaataggagccatgatataaatggccttttcccccttgttgatgaaccgctcaaactgttccttccaccgcttggcgctggctacacgggtggcgttgggccgctgcatgtggatgagaaggacgttgcgggcggaataggtgtgaaaccgggacatgacggcgaggtaatcccgaaaccgctcgctttcaaacacgtcccggatgccctgctccagccgctggttcaggtccttcatacgttcctcgcggctgggatagcttttctttgccataaggcgctcctttctgcacataaaaaatgcccccgcacaggacgggaaacaccgtcccgtgcgggggtggtttggattgaaaaatagaaaaagtaaatgcgttttgtgggctgcctgggaaagtggtttcccgctccggttttaccgctgaaaagccccggaaatccggccttttcagcggccgctttttctaaggtctgcccttgttccgggccgcccactcgcgcttgctgcggcgggtccttcgtgcggcgcactccgggcagtatagggtatttttcgccttggggacaaagggccgcctgcactcccggcaccgcctccggctgtctgccataatctccgcttgcagctcccggtctgcgggcaggacggcggcgcggaagtaccggcagagtacggagcaggtgagcatctgtgggcaggggcacggctcatacccatcgtccagcagaaggcagttgccgccgttgcagttggcgcacagggaccggatcagccgtctggcccggcgaagctgggcctcggtcatacggggcgggtcattcatggctgaactccagccggaagctggcccgcgtcccgtcgtccgtgagtgccaccgtggccgtataggtcttgccggtcttttccgaccacagaccggagatctgggtgcgtccgtccttcagcagcgcggcgacaatagccttagtgggcgttttctttttgttttcccaccacttgctgtttttccagatggcgaaaccgcaggcccggttttcacagaaaaagccctgcctgccctcggtgacggtcccgccgcaccgtgggcagcggcccaccgcctcgcgggtggaggggaacagaaccgcgctgccctctaccgggcggcaggtctccaccagttcccgcagcatggcggcgatctcgtccatgaaatcgccgggggccagtgtcccgcgctctacctctttcagccggtgctcccactcggcggtcagcgtgggagactgtaactgctccggcagcaccgtgatgagcgccgtgcccaggggggtgggcaggagagagacggttttctttgcccttttccgctccacaaaaccagcggacaccagtttttccagaatagcggcgcgggtggccggtgtgccaatgccctgcctctcggcatcttccggcatatcctccttgcccgccatctccatggcggagagcagggagtcctcggtgtggtgcttgggcggcgtggtcttgccggacttgacctgggcggcggccaccggcagcgtctgcccttccgtcagtccatccggcccgctcccagcctccgcgtctgccgtctgcgcgtataccttccagccgggggacagaaccgacctccacttgacggtataggggtctccgccgcataccgccgtgatgcaggtctccgcagagcggcagggcgggcagacggcccggagcaggcccaaagacactagccgcagtatctcccgttccccaatgggcagggcctccagatccgccttgcccgcgctggccgtgggcaccacggcatggtggtcgctgaccctggcgctgtcgcagacctgtccggccagcaccgtctccggcgcggtcacaccgcaaatggaggcagccgcctcgaccagtgccgggacgcccgcctccatatcgtccgtcagataccggctgtccgtccgggggtaagtagagagcttcttgtcatagagggcttgcaggtagtccagcgtctgttgggcggtgtagcccagggtgcggttggcctcccgctggagggtggtcagatcaaaaagggcgggtggcttctccgttttctcccaccgctccacagactggaccacggcggcgctgccctggcaccgggcggcggcctcctgcgcctctttcttgctggccttccggtccccggccagggagagaccgtcacagtccagctccaccatgtagaacggctccggctggaacgtggcgatctccgcctcccgctggaccaccagcgccagcgtgggggagaccacgcggccaatgttcagagtgcagccatagagcagggagaacagccgggtggcgttgatgcccaccagccagtccgccttggaccggcagagggcggcctgatgcagcccgtcatactcccgtccggggcgcagatgggcaaagccctcccgaatggcctcgtcctccatggaggaaatccacagccgggagatgggcttggagcagcctgccagggcatagaccgtgcggaaaatcagctccccctcgcggcccgcgtcgcaggcattgaccacctcggacacgtcctcccgccgaaggagggtccgcagtacgtcaaactggtcccgcttgtccttggcgatggtaaaccgccagctctccggcaggatgggcaggtcctccttccgccacttggcgtaggccgggttatacgcggcggcgtccgccagctccgccaaatgccccacacaccagctcaccagccagccgtttccttccagatacccctcccggcgctgtccagcccccagcacggcggccagactttgggctaccgagggcttttccgcaattaccaactgatacaagtttgtctcactcctttttcaagcagcataaaacgcttgcacggcctgtataataatgatagaatactatcaagaaaatataattggaggttttgctatgattatcaagccatccaccgctctgcggaatgattacggctccatctccgacttggcccacacggaggatgcgcccatctacattacaaagaatggcgagggcgatctggtcattatgagcattgacgcctatgagcgccgggaagaagttttgaagctgcgggcaaagatagaggcggcggagcaggcgcggttgtccggccagccggtctattccatcgaggaatcccggaagcgtctggaggccatctatggacaggatctgtaagctggatattttagcgcccgcccaggcagaactagaggaaattgcgcgtgtccacatggccctctccggcccccggtccgctcaagaaatcaccgataaaatctacgatgccatggagcagttgacgcgttttccgctctccggcccgccggtccgggatgagcagttgcgtgtcggagggtatcgctatatcctggcgggtaaatatctggtgatctaccgtctcctgggcgatacggtggtcgtgtaccatattgcccacggcgcgacagattaccccaagctgtttcggacctcctatttctgaacatgatctggacggttcgtgatgcgcaagttgcccttgcgccggtctttgagcaatatggggtctcccgtgctgtcctgttcggttccatcgctcaggggacagccacacaggaaagtgatatagaccttctggtagacagccacctgcgcggcatgaagttcgtggggcttatggaggcgatccggcaagtcactgaaaggccggtagatgtgtttgacgtgacccatattgaacgcggctccccattggactgggaaattcacgccacggggatcacaattttcgagaacgcaatatgaatcagggtatgaaggacggcctgccgcttggcgggccgtctcttttcatacttttgctggataaagctgcatgacgccccggtgacagggcaggacgcagccctccccaaaacgcttgcagccgtggcaggggtgccctttggggcaggagcagggcgggatggacgcggcctacgtgtggccggcatcatcgtccgttcataggggctgtcagtgaagcatctcacagttcctcgtcctccgtctccggctcgtccggctccgcatcggcgtcctcctcgccctcgccgtagtcataatcatccagatcggcgctgcccctggtgctggcctgtttgcccttgaccagcttgaagtaggccagcgccccaccgccgcccagcaggaccaggacagccagcagcacggcggggttcaggccgcctacccctttctccggctccggcgtttcctccggttccggggtgggttccggctccgcctcctttcccgcgcactcggtcatgttgaccgcacacaccgggcaggcggtgttgactgccccagccgcgcacttctccatgcaggaacatgcggcgggttccccgtcctccatgagcgccatcaggtcggcctcgtctacggcgttcaggaaatagacggtgttctcaccgtccgccgcccggtccacaataatataaaaggtattgccgctcttggtctggacggtgataaactgcttatccccggcagcgtcaccctcaatgtcgtccacgatggttaggttgccctccggggtcaggggttccggctccacgcccccggtgacgggtttctccgaagttccttcctccgggtcctcggcgtaggcgaaagcggcaggggtcaaggcggtgcagcacagcatcacggccaacaggccggtgaacagacgagttttaagtttcctcatagtttgcctcctccttttccgcagggtcggcagactgcggcccggacggacgggccgcctgcatgagcgcggccagctcgtccggcgtcacgcccatgcgccggacaatgcccacaatatccaggttctccagctccgtcacctgtttgtcgatctcgtcgttgcgggcgttgagcttggcgatcttctcgctgtttttctcccgctccgccagcagttttgtgattttcgggttcaatgaaaacactcctctcagggcaggcggccatagcaatataggtgctcctgccagtagcttgtattcaggtttgcgtaagagattggggacccacagtggatcatcatgccattccccacatagatgccacagtgagagacccccggcgtatcataggtccctttgaagaacaccagatcgcccggcttggcattggcggcggtgacgggggtgcagatgttgcacaggccctgcgcccccagccgccccacatcccagccgctgtgattgagcacccaggacacgtagccggagcagtcaaaggaggtggaggggctggacccaccccaaacataggggtagcccaggtatttctccgcctcctccagcatggcggcaaactgctcgtcctccaatgcctccgggggcacgtcgtagtccagatagtcctccttttgggaggcgttggggtactggctctgcgggaacaggtccgggcggttgcccagggtcgccatatagacggcatacatggaaagctggtcctcgcccatgatgtagaccggcaggtgggacaggtcggtattttccagcgttacatagcagatgtaccaggagtaggggtccccctcgctatcatgccgggtctccaccacgacacgctcggtaaggatatactgcttctcaaagagcatatccagcgtcacttgtacctcgtccagcgtccactctccctgatgataggcggtgaggatagaaatgagcacataggggtcatgcccgatctcgtccaggtcgaagtggtattcgtcgtaggaatgggtactctcgtaggtgtccaggtagttttgcagctccgcctccatcccagcataggcggcctccgcgcccagcatggcctcgtcggtagagggataggtggtgctggcgatgccagacatgccgccctgcaccagcacggaacaggaggacatgcagttgaggaagaacgcgactaccagaaacaggcccgcagcaatcagaaggccctttttgtgcctccgcgcaaagtctgccgcctgacggctctttttcgccgccttctttgtagactgggccgtgtgcgcggtagtctgcccaacggtggcggcggtctgaccggcgcggcgggcggcggcatactgccgcttgatggcctgcttctgctgccaacgagacagcggattactagaaaggccggggttctcttccaggctcttttgatatagggcattgacgttcgccttttccagcttccgctctgccgcagccgccttgcggtaggggcgcagcttttgggagcgatacccagcccggaccagacgcccggcgctctctgccgcctcctccgtcttatgggcgctctccactcccacattgtccgcctcactctgccggacctcccgatgcaccgcgcccagcaccgtatctgccggggcatcccgcagcgcatgttggagcttggagggcggcttcttgtcctcaaactgcaagcgcaccgtgacggccccggtctccgggtccacggtgcgctgcttgaccttccgcttggggaccttcacctgggcctcatccgcccggtccgccgcccgatccactttgcggatgggcttttccagggcgggattttcccgttcctctttcgtaaactgcaagcgcggctctcgtctcaaccagacacctcctggggcttggtggtcatgatcctgtaaagctccgtgtccttgggaaagcggtctataaagggcagaatcacgttgccgtagaacagcagcccctcaccctcgctggaatgggtcacataggagagctggtgggggctgatgttgagctgcttggctaaaatctgccggtcccccgccgcctgattgagcatatagatgaagtccgagttctcgaagatattttcgatctcgcgggaggccagcaggtccttgatattctgcgtgatcccggtggggatgccgccccatttgcgaaatcgcttccaaatctccacactccagcttgccagctcccccttgagcagcaggtggaactcgtctacatagtagcgagtggtctttcccgccgcccggttgaccgtgacccggttccacacctggtcctgaatgaccagcatccccagctgcttgagctgcttgcccagctccttgatgttgaagcacaccagccggttggtcagctccacgttggtccggtggttgaacacgttgagggagccggtgacatacagctccagcgccgccgcgatgcgctgggcctccgtttccggctgagccagcagctcgtcgtagaggtcctggagaatgggcatccgggctgggtccgggtctgccaggtaggggcggtacacattccgcacacagcggtcaatgaccgttttctccaccggctggaggccgtccttgctgcccaccacgatatcgcagaaggagagcaggaagtccaccttgagggccagggggttgtcgtcgtccgagtagttgaggttgatgtccatggggttgacatactgggtgctagtgggggagatttttaccacttgcccgcccaggcgcttgaccagtggggcgtagtcgactaggtcggggcgattactcgccccttcccgtctaagaaccgtacgtgagcgtttccactcatacggctcaagcatttcatcacgctttcgcgcggcgctcaaagtagagttggttacagtatttgtggacataggccatattgcgcacctcctctttgccgcctttggatttcgggaccttgaaaaagatttctctttcgtcctgaatgtccatcggaagcccacaatgatggcaacatccgttttgattcttccaaatctgtttgaacctgccggtaaaacgcttcatgccgcggctgaattgcctggcatgaaaatattccggctccaggtagggattggcgtccattcgtacttttgtatgtcggataataggaatgtgatccacccgcagaagttctttgtcctccgtggagaatacccagtttcggtttcctctgcggtgccagtagtttgtggatacccaccatttccccttgtgggggtgacggcgtttggcccacctccacagcagttcatagagaacatagtcgatgtgcgtaaacgcctcactggcacagaccgatcgatgatagttcgtccagccccggatttgttggttcagcttttcaatcagaaggttctgtttccaagccttaccgcgtccaaggatggtttcagacaagctggccgtgaatgctttcaaagacttttttgacggcttcacaatgagctttccgttaaatttccggaaagtccagcccagcatatcaaatccgtcatcaatgtgggtgatgagcgttttctcctcagacagttccagacctctggttttcaggaaatcacgaatcagttctttggcctcttcggcaatttcctttgtggccgccgttacgataaaatcatcggcataccgcaccagatttaccttgtgggcgttgcggaaccgattgtccactttgcccagccggttggtatggaaccggtcggagagcagcttttgcatcccatccagcgccatattcgccagaatcggagagataatgccgccttggggcgtacccgcctctgtgggaaacagctcaccctgaaatacaaagccggctttcaggaattgcttcaaaattgacttgtccatggggatgttgtcaatcagccactgatggctgatatggtcgaagcaacccttgatgtcaccttccagtacccactgtggactgacgtttctgcggctcatgtccgcaaaaatatattcacaggcatcctgacagcaccgtccctttctgaatccgaaagagcggggatctgccgccgtttctgccacggggtccagtgccagcgcatagagcgcctgcatggcccggtcatacatcgtgggaatcccaagagggcgtttcgcctttttgttcttcttgtcgatgtatacccggcggaggggactggctttgtagttcttatccgtcagggacaacaccgcccacatcttttgcgcaggtgtgctccaccgttgtttgtcgataccgggtgtgtttttccctttgttggtggttactttttggaccgccagcagttttgcgtagtacgaatgcgtaagcagatattgcagtcgttttactgtgttccatttcttttctttggtcgccttagcaatccgggcttgcagcctattaacctcggcctcggcttttttccaatctacatgattccactggaatgccagctttgccgcgttcggcaatctctcagagcgtttccgcttcgtcgttgaacaattaccgttcataggtttacctccttttcttgctatgaaataccgtgggataagtcagcaccctttcaggtcagggcagagcccctatgctccaccattacagcagagccgttcgctttttatcccgttcctctaccctctgtgtcatttcttccccttacggggtcgatacctctcattgaattagaggaacacatagggtttaccacgttccgcgtattgaataattgtgcgtgctttaggagccatctttgagccgggaggaatgatgtccatttgccgggggattgcgaaagttcccacggccacctccgcaccttttggtgtaggcgtgtcagcctgatttcgcctattccctgtaacgacccttgcgatgattcacgttacgttctccatggcacacttatcctggcagtacggctacgttaggctcgcagctttcccacgttgtcccacaggcttcccaccccgccgttaccagcgacgcaggctgtggtaggattaccccaaatggatagggcagcttgttcagcaattcaattacgcgacttcgtgtcgcacctcgtcctccgggtcacagaccagcacgtcgtcctccgtgacgagaaacacgttggtgatctcccgcttggagctgaacgacttgccggagccgggggtgccgagaatgaggccgttggggtttttgagcagtttccggtccaccatgataaggttgttggacagggcgttgatgccgtagtaaagggcttcggggctggtctggaacagctcctgggtggtaaagggcacaaagatagctgtgctggacgaggtaagcccccgctgtatctccacctgattgagacccaggggcaggcagctcatcagcccttcctccggctgaaggtccaggggcaccagacggcagttgtgcttctgcgcggtggaaccggcctggaacatgttgttgtccagttgcttccggctctccgccgtgttcatcagcaggaacgccaccaggaacatgcgctcattccggctctggaggtcttgcagcagcttcttggcctcctcgccgtaggtggcaaggtctgaggggatgatgtccatgtcatacccggcccggaccgcttttttctgttcctcgatcttggtgcggtccaggtcggtgatcttacgcttgatggtcttgatggcgctgacctgatccacagactggacgtgcatggacaccacaagactggactccatatccaggaaatccgccagaatacggtcattcagctccggggccaggatttggaggaaggaaaccgcgccgaacttccgacccatacggaaggtcttgccgcccggaaattccaggggtgtgggggcgatgaagtccttggtagacaggccagagggagccagccagtcccaggaaaagcgaaatggttccggctcgtccatgtggaagatactatgcagcaggcacaggcgctccgcaccgttgagaggcgcggcggacacgcccagccgcttgaagtggttgagcaaatcggtctcgatgcgctccagccggggcttggccgactggatactctccgcgtcgacgccgaaggtgaggtacttggtcttgaccagaccgttatttcctctggcaagctggttttgcagcatttccgtgtactccgcccggatgctgtcaaaatcgtccccctggggcgggatcacgatgcgcttctcatagctctccctggtggccgccagattaaggaaggaaaactggaagcggatggagctgtcaaaatagttcaggaaatcacaccacccctcgaaaatggccgccttgtcctcgttctgactgagctggtaattgatgtcctgaaactgcaccgtcttggtgtagtaggtgtccgtgacccggcacacgccgtccggccacatacgttgataggggatgctgtcctgggcggacagctcctttttatcggtccgggccgccctgcggatggccgcgtcgatctcccggcgctcggcgcgggtcagcctgcggcggccttttcccggcgcgtccttggcaggcgtttgcttttttgccttgaacaatgcgatacacctcccggtctaattggtcctgccgcgcaagggcggcgtaaaagttgttggtcttataggggcgctttttcgggcgcaggaagtacaggcgcacaaactgccggaccaccttctccagcggctggccgttacgctcgtacatcgccagaaagaaaaacgggagcatggtgagcaccatcaccagagcggcggtgctggtgcccaggctaccccggaggaaaaagaacagcggaacgccgatgagcgcgccgctgccgaagcagatcagttgtcgcttcgtcaggttgaaagcgaccttcgtttttacttttgtcaggtccttggggaccgaaacataggccataaaatcaccctttccattggttaatgggcattgaatacggattttgccatgctgctcgtcttaaagagcatgaaacacagcagtaccgtgtagcccatgcacgtccagatggcatagctcacatcgccgtccagggcaatgttctgcaccaataccgcgtagatggcaacacagacgatgataagaaacgcctggaagcccagggcaaacaggctgcgcagatagctttgccccatctggccccattcgtggttcatcatggtcgccatggggacaggggccacagacgtgaccaaatatatctcaatcattctcccgaatgtaataatgaaaatgcagatcaccagcgcccacatggtaatgcccacaaagagggattggaaccacaggccgaacagcggccccaggtccatctccatcagccgggcctccaggtctgcggtcacgctggagatgtcgatagcggtgtctccgatgataacgccggaggcgttattcaccatgccctgcgccacatcaaagacccccatcacaatatcccaggtattggtgacaatgaggatggcgcaggcggatttgaaaatccacttgaagaacaccgcgctttcaatgtcgtggaagttgttcttgtccacaatgagctggatcagctccaaggtcatcacaaaggccagaatgaccccggctatgggcaccatgaccgtctccgaaaggttttggaccatgctgaaaatatcgcggttccatgcctggggggtaagcccgacctgcgtagagacctcgccgaccttctgattgacctcatcaaacatgccggtcaggttgcccatgatgccgctgaccaggatttccttcagccagtcagtgaggacctgtataataaaatccaagggtaggcacctcctatcacaccgtcagggtcaggggggccgcacccggccaggagaccgggtgcggcctctctttgcccaatcaggtggtaaagaggccggagagcaggggcaccagcaccatgccaacgatggcgacacccgcgcccgccatgagctgcttcattccctgtgatttcgcgccggggttatcattaccataaccttccaaaaggttaatgacgccccacacgccaaggccagcgcccagggcgatcaccagggtctggagcacttcgattgcgctcttgaaaaaatccatatagtacctccgaaaattcaaaagattttggaaggtacacactttcctcctttttgcggaataggccgctccgcctacgcggtggcggcctcctcgtccgtcaggtctacctcgtacacgtcgtagacctcctcggcttttggcttcagccggacggacaggaaacgctctatgtcaaaggcgtttcgcttgtcgctgtccgacagatacttgtagttggggtgcttcgtgatgtcgtacttgtccgacaggaaaggccggacgccgcgcagttggagaatacacttgccgccgtccaggactgccagctcatccatgctggcaagctccttgcccagcttctgataattcagggagtgggaggtctcccgccccctgctctctccggtattgtaggtgtcgatggtctccttgcccagcgcagcggacagctccttgagggtggtgggttctgaaccgcccaggaacagccttgcgtccatgtttccaatgatagtgtccgcgttgtcccgatagagcgccttgagctgggactgtgcctggaggaccagacaggcggaaatctcccggcttcggatggttgccaccagcttctccagccggggaatttgcccgatgttcgcggcctcgtcaatgaggcaccggacatggatgggcagccgcccgccgtacacgtcgtcggccttctcacacagcaggttgaatagctgggtgtaggccatgctgattaaaaagttaaacgtgtcgtccgtgtcgctcataatgaaaaacagggcggtcttgcgatctcccagggtgtccagctccagctcgtcataggcggtcagctcccgcagctcgccgatgtcaaatggggccagccgtgcgccgcagctcaccagtatgctcttggcagttttgccagagacaaattgtcaaggactttttcatcaaattcacaaaaaatccacaaaaaaggtgccagaagcaccgtatggctcctgacacctcgtttgatagattacatttttccgttcagcaggtctttgcagagatacgcatagtctggcagctggttgatatatggctcccagcgccgcttgatttcggccaattccagcggatcggctgcttccagtgcatgatcgttgcctgtcatatataaaacatccgtagcaacatcatccaaacacctgccgcagagatcggcggctgattcgattctgataccggtatccacatagactggattgacgccaatcgccagccagacatagcctaccttgtccgaccagagcagttcaaaatcagggctttgccgcagatgttccgcaaagatctcctttactcgttcaatttcatgcttctctttttctgtgtaaagcattttcgtgtcctccttgacaaaaattttggtgcgtaccatcatcagtttagcacaaggcggcttcgtttatcagtctgtcacatctgctgaatttcatttttgagcatacgcttgattttatcgctcatggtttctgtgctggtattgctgaaatggacatgaaccttgtaggttgtcttgccgattttctttaccatcgctggcgtgttttccggcgctctggacacagtagcggcgtctgccgcctgcatagtacggggttctttgttcatggcgctcctttctttgagcgggtctgtgccgcccggtaaaaaatcagtcgtgcttactgtttacaatgtcttttgctgtctgtcgggtagcaccggcattttcttcccggaaattcttcccgtcaaagagaatcggcgcacaccgttccagaatacggtcatagatacgggcgtgggccagatcaggcgggtttttcagctcggacagtttcaagtttgttgtgataatcatgggcctgcggctgcgatagcggctgtcgatgacgaaaaacatctgctccatagcatattcggtactgcgctctacacccagatcgtcaatgataagcaggtcgtactcgtcaaagctggcgataaagtcggccttgtcctcggaaaacatcccggtcaggcggttcaggatggtggggaagttcgtcatcagcacaggcacatcctggtcaagtaaggcattggcaatacatccggcgaaaaaagacttgccggttcccacatccccgaacaacagcaggccggtgttgtttttatatgcctccttccagttctccacataggcgcgggccttgtccatcaatgggtttttgccgttgtcgttggcaaaggtgtagtcatagagatagcggtcttgcaagccctgtgcctttcggcgtttgatacgctccatgcggcgctgccgttcctcggcggccttacgctgctcctcagcctcccgctggcactggcagatgcagcgcggcataaagtagtcgggtttcccaaagcatggcacaacggtctgcctctggccgccgcactttttacagtgaatgaggccgtctgccgggtctatgtactcgtccccggccagttccataccggcggctgccttgtcgatcagcgcccggatttctgcggtaatctccatcatacggtttcatcctcctttacgctgtaatcccggttgcgggtgggcggggctgctttcttcgcgtcctcaccggcccagcgccggatggtcgcggcatggctctgataccgcttgccggtagaggccatgtactcggacagcttttcgatgtactggccccatacggtgggaaagctggcctgcaagtctgccagttcctcgtccgtcaggaaaacattctggtaacggccataggcgcgggcggagcgtcccttctctatctctctctttatctctatctctttctctaactctatctctatctctggtggacgaatgtcggacaaatgtccgccgtttgtccggggcgcagaaagagccttattttgaagccttgcagcccgctttcgctcggcctcggtagaggactggcctattaaaagttcgatgttgctcatgtagaatgtgccgctgtccagcacttccacaagacccagcttcaaaaagatctgcaaggctctctccacagtgccgatctgctggcgggtaatggtggcgatcatctgcgccgtgtaaggaatgtcctcgtcaagttgaagccgtccaccatgtttcagcgatttcagatacagcttgagcagaatgttggaatatagcacaccatcctgcatactttccagcagcacgatggaatcatcgtcaaaatagttttctttgagtttcaggtaataatattttcggttgtctgacatagggttcctccttggggtttctcttgggattctgtacgcattttaaggccgttttaggggtcagaggataaatctatcagcttaccgttgacaccctcgaaaaaagccttgatttacaagggtctttcggcccctaaagcgtgacatttctcccgttgtttccgcttgcgctttgcggcgttgatccgcttcatgcacgcggcacattcctggcagtatttggctcggttggagccgggagtaaacagcgccccgcatacggcacatttcttagcattcagccggtggaacagcgccgtttccagttccttatcctgcggcaataccgccgcccgaaaccacctgcacaacagggagtaggaaatagactggacacagacacattcctccccatcgtccagggcgatacagtttccgtcgatgtagttacagcactcatgcaccagcctccgcgctctgcgatactggcggtaatccatgacagggataggttcagtcttgttgttcttcataaatgatttctttcataaagccggtaacctccttgaatgaatttattgttaaatattcgtgcaaagtattgttttcttcgtgcaaatggcatatactataattgtcagcagaaaggggttgatcgtatggctggaaataccacaaacatcagtatccgcatggacgcagatttgaaagcgcaagcggacgcactgtttactgaacttggcatgaacctgactacggcgtttaacatctttgtgcgccagtcgcttcgtgaaggcggcattccctttgaagtaaggctggaacagccgaacaaggaaacggttgctgccatgctggaagcggaaaggattgcaaaagacccgtctgtaaagggctacaatgaccttgacgagttatttgctgacctgaaaagatgaaagaaaccaaatataccgtcaagtacacgaccagtttcaaaaaagactacaaacgagccatcaagcgtggcttgaagatcgagctgctggagcaggtcgtagcgttgctggcgatgggcgaaccgctgccagataagaaccgtgaccatgacctgtccggcgattgggcaggccatcgggaatgtcacattctcccggactggctgcttgtctaccgcatagaagatgatgttctggtgctgacgctggcccgcaccggcacacacagcgacttgttcggcaaataaacagtctgccgccgtatggggaaacctgtacggcggtttttctgtgtgcaaaagtatgtcgtgaaacgcggtagcccttaccgctccggctcccgatcgtgagacttgtcccgttcctgtctggacagctgctcggcggttttgcggagccgttccactgctttcaaatcctcccgcatggatttcatggcaagcgtgtccgtctgctttccagcggccagctggtcgatttcccgctgccatgcctttggggtgattgcctcgccgctgtctttcagttctttcagataccgggccgctgcatcatacagaatcagttcccggctgtggcgctgttcaaactgttcccgtttttccggctttactttggcaagctgcttgtggatggacttgtactggttgtactgttcccacatctccccgcgttcggtaagaatggcgatccggcgctcagccttgacgatctttccgcgcaggtcatagtaacggctgttcatatcagcgattttttcatgaagctgctgcatagactggatgccgtttgcctgcaaaaagctgaatagtgcagcgctttcctgcaaagcccggattttgccggtgcgggtgtggggagcgttcaactgctgctgagcctcccacaaagctgtcaagctgctttgctgtgtttgtggtttttccgtttcggctttcgaccagcgataaagacgggtaatgcgggctttaatttctttcagcagtttgttgtcggcggcgatctgtcggtttacttcccccttgtcggtgcggataccgcgattttccatttggctggcagctggccccagatggacagaggggattttatcaatgccctgccgcttgtagctacggtggtcaatgcgctccggtctaccggcagattccagcgcccggttggtgtaggctgcccacgctgcccgccaaatctccacatttcctttatcgttccaatcggttgtatcctcacgatgatttttccagccgcctttcccatccgggatacgctgtccattctcgtccagatcgtatgccttgcggcactttgcgccccactgtccattttctttcagaggccggagcgtcagcatgatatggacatgagggttgccggttcccttgtcatggatagcaaaatcggcgcacatccccttgtccacaaagttgtccttcacataggaccggacaagggcaagctgctgttctctggacagttcgcggggcagagctgcctcaatctcgcgggcaagctggctgtcccttgctttctcaatttgctccacgctgttccagagggtggatcggtctgcaaattccggcggggcgtgggcaggcagcatgatctccgcatgaacaatgccgcctttccgggtgtagtcgtgggtcattccgtcccattcatttgtcagcttggttccgctgcggtaagcagctgcggcaacggcagaacggcctgcgctgcgcttgataatactgacggggatatgacagaaatctatggggaacacctcctttcagtgaggggataataggctctgtggagccgaacaaacgcaaagcgggtgtttggctgtgcagagcgcacaaggggtttggggagcgtagcttcccatcgcggacgaagtacgcaacagccccggcagggcgcacgacaccggcaacggtgtataagtgcgcccttgtaaacaagggacttatggcgtgtccccggattttggcaggtttgcagtcaattccgcagcccccggaagatgggacagggcaatcagaaatgttttgacctctgcgccggaaaggttggaggccagcggaaaaataccctccaaaatggctccgcgctcaatcaggcggcgggtacgaaccctgcgttcttcgttccgctgcttgttctccaaaatcttctttcggttttcaagctgccggatctccttcaggactttctcccgttcttcttttgaggggtgggctgtaattttttcgttcatgtcaggcacctcttttctttgaaaatactcatagattgaccgtccatttctgtcgagcaaagtaccggcgcagcctccgcagtgcagcgtggatggattttcccgcctgtgatggtgtgataccatccattgcggcaatatctttcactttcatacccagcatatagcgggcatggacacggcgagcctgcataggcggcagggaagaaatggcttcgtacaatcgccgtatcaattcttcgtattcggctaattcttctttttctatcaggtagtcttccggcgatggctgcgcccagccgatggcggcattttcgattccatcgttacaatcgagggaataaaacgccttataccggaacatcttgcgatctctggcggcctcggctctcttgtccagaagaaacgcttcgacgatctcatcggacacctccacaaaaatgtcctctttgcaaaatggataatattgtttgagattgatggtctgcataggcacgccctcactctgtttgaaaaaggccatcatagcagcggcgcatattccgcagacctcgacggatggcaacgctgaccttgctgctgtggatgccctctctccgggagatttccggctgcttgataccagcaatgtagtaggcgtgaacacagcgggcctgtgtcggagtggcatgagccagagccaccggcaaggcggcaaccagccgcaggcgggcggcccgttcctcacgctccaccagaatatcctccggcgatctgccgtgttccagcgcgtagttctccgtccagctatatgcgtccagggagtaccaggcgcggtggtagaccttccggcgctcatagttgttcatctcgcgctgggcctgccgcatggcctcccagacctcgtcgctgacctctacaaactcgtcatgccggtagtggggatacatccaccgcagattgattgttttcataggcttacctcctgaaaatcggagaggcgggcagcttgtccgctgtccgcctctcgctgagataagggaaatgatccctttcacttgatagcccgaaaacaggtcattcgttaagcctgttctcaaagaaatttataaatttttttctgaccgcctccacactttgataaacagccactttggagcagccgcacagcacaccgatctctgcaaggctcagcccgtcaagcgcatagagcaggaaccggcggcgctgggcctcggtacaggtgtccagaacagccatcagctcatgcagcgtttccatgcggcaaaggtattcctccggcgtttcactgtaaacgcccacgccctcggtaaaagctatgtactcgtcaaactcccgcccgtcccaatgccgccgctgttcatggaacaggttctccgttttatgatcggcccggtcaagaaattcatagacttccagcgtaacctccacggccacagcttgtccgttataattgatggtaacttccatctgcctttcctccattcagatttttttggtaaatctgaatggggcggcggagaacggcactggggccagagttcgggccatgctggcccgatgttacggccccacaggtatgaaaaaacgcccggacagcagaaagctattcgagcgcaaaaactccaatattcacttacagaatgacaattttcgcaccggctgccagacggagcctgttcgttgactgggctttttttgacggtagtgaaatatcgtctgaatttgtcggcggtcaatgtgcttcatggcggttccctcctaaagccgccgtgtcagcgtgtagtcgtcactcctttgtcgagggcataaggaacggcggccttgatgttactcaaaaccgccgcagtacctggaaaatccattttgggcgcacaaagctgcctgccctgcaacggtttttttctttccccgtcttgcggggcaggatcgcttgtcttatttggtttaggtttgttcctgttcggctgcctctttcagccgtgaaaagctctcatcgctgatgatgtgttcaatccggcaggcgtcagcctccgcagtcctggggtcaacgcctgcggcgataagctgctcggtaaagaagcagtgacgctcgtagattttttcggctacctcgcggcccacatcggtcagatggagaaagtgatcttcgtccatagtgagaaagccgccgtcccgcaagatagccactgcatggcacacgctgggctttgacacctccatgtgccgggccacatctacggagcgtaccataccgcgtttcttttggagaacaaggatggtttccaggtagtcctccccggacgcatgaagtttgttcttgctgctcattatgccagcttccagtttttaatagatttctctttttcccacatagtttgataaagcggcacggtctgcaacagttcttcatgtttcccacagccttgcaatatgccgtcagataggacaagtatctgatctgaattttggatataggacaaagtgtgtgatacaaggaacaccgtcttgcccttaatcatttcttctatgcccttctgtattgctacggcattttcggcatccagactggacagcgcctcatctaaaagaatgatcggggaatctttcaaaattgccctcgcaatagcgacgcgctgacgctctccaccggaaaggcttgcgccgccctcgctgataaccgtttgatagccctgtgggagcttttctataaattcgtgacagtgagccttttttgccgcctctaccacctgctcgtccgttgcgctctggtttcccattcggatattattcatcatggtatcctgaaaaagatatacttcctgaaaaacgacactcacatgacgcaccagatcactatgctttaatgttgccgcatctttccaattcaacagaatccgcccgtttttcggcgtcacgaatcccggaattaaattaaggagagtggatttgccgcttccagaaggacccaccaatgcagtgatcgttccgggtttagctgaaaaacttacatgactaactgcgtcacgctttccatcatagctaaacgatacattttcaaaccgtacatcggcttgtgtatctgcaaactgtgtagttccctgtttttcattttcggtcggcaggttgttgatttctgctatattatccaacgatgcgtttgcaagattcatcatggcaaaggaacccatcagagcttccagcggacggtaaaaaataatacccatgattgcaaaaaacaaataggttgccggggctaatgaaccagaacgaaccattgcaatgccaacacccaaactcaaaaacaggcccagattcaggcagattttataacccatgctccaattcgtcagcgtcgcttcataacggtcagaagccgtgcaatatccgttcacctgcttctccacgagcttaccggattgctccagccggtatgccttgatcgtttccatgccctgtacatattccagcgtggaatcaatcattgccacctgcgtatttttcttctgctctcccagttgaaccatgctcttttgaaactgctggtagaggatatagccggggatgatccccgcaaacagaagaagcgccatacgccagtccacactaagcagcatcagagcaaatacaaccgtcatgatcatgctggaaacgaaaccggcaataatctccatgatattcatttccacgaaacttaaatcagttgtaaacaaagatgtaagctggctgatcttgtcttttgtaaagtagtagagcggaaactgtttgattttcgccgcaatcgaaagacgttcatcccgcatcatggcataagataccgggcgctgttttgcaatcgtaaagtaataaaaaacaaaatgcaggacagtatagaccagaaacataaggctatactgcatcagtttttcctttgtaaacgagccgcccaaaatatcttttatcgcaaggaacagcatgaaatatatcgcgccctcacaaattgaggtcaacgcctgaaacagccacgcaagataaagctgctttttgcgctcgcctgcaaggtctaagaatttccttatcatagcaatcatgcgtttacacctcccattttccattgatcggattgttcaaaggccgcccacatatcctgatacggggagcaacggtttatcaattcatcatgtgtgccgcagtcaatcactttgccctgttccagaaccacaatcgaatcagcttccttgatactggaaagacggtgcgctattacaagtacggtttttccctctgataatttagctagcgccttttgcagtaaatcttcattgtcggcatcaatgtaagccgttgcctcgtcaagaatcacgaccggcgcatttttcagaatcgcccttgccaatgtgattctctgtttttcaccgccgctcaacttggtttccttgtctatcactgtgtcatagccctttggaagccgcataataaagtcgtgacatacggcatccttggctgcctgcatcatttcttcctccgtggcctctgggtttcccatcataatgttatcccggatgctctttttgaacaggaacgtattctgggtcacaaaggaaatctgggacatcagatcggatagcggaatctggttcagcggtacgccgcccatacaaatctgtccctcggttatatcccaaaaccggcagatcaggctggccgctgtacttttgccgctgccggaaacaccggcgagcgccgttacttttccgtcaggaacagtaaatgagacatcttttaataccggctgttcttccccataggaaaatgtaacgtgttcaaacgcaatcgtgtggtcggcaagttctgcctttgaggtcgtatccgccatttcatccagcttcagaatttcgtctatcttttttgcaacagaggcgttcatgccgatataatcaaagttattagaaacagtttccaacggaatcagcatggcaagccccataaacagatacataatatagctggccgctgtcacgctgccggagaggtacatcaaaccggcaagcggaaacaggaacacaaggttgctgtttaagtcggtatgattgaaagcaacatatttcaagcagctttggaaccactctgttacaacggtgctgtaagtgcggatgctttctgacaggcggccataagtggattcgtcggcagcaaatatcttcagttctttcataccgttgacatattccaccgtcttaacgctgacatcggcaaacgcctgattaaattcgtccatttttttcatctgaacgataatcataagaataccgacaagaataaacagaacgaccggaatcagcatgataccggttaccctgatgtccaatatcaccagaaggatttccatacacagcggtacagcgaggccggaaataatctctggaatgttatgggcgtaaaatgtctccaactgttccatattgtccataatgatcgttttgacctgcccggatgccgttgttttcacatagcccattggtaagcgggcaattttacggaacagctttttacgggtttcccccaatgtctggtaggctaccttgtgagagatttttgtgccggttccaaacagcagatgtttcaaaatgattgctgcggcaatcaggcacacatattgaaaaagattctctgtccgttcattcagaaaacaggtcacaataccccaaacgcccaaatagggcaggatgccgcacaaaacagacaggacgcaacagattactgcgccaagcagacgacgcttatttttcttatcaattagtccaaacagggcttttacatcatccattacaattcatctcctccttgtggaatagtgaaatcccaaaatctgtccgatattccattttgccaaccagatataacagtagttccatgactttaatgcgcataagataattgcggtactgttccggcagcaagagcagttcggtaaaaatatgctccacgctttttgtcgcgggtgctataaagcaaccgcccgctgtaaaaagcccttgaaaatccatgtcctcgtcaaacgcgattgtccccagcatgatattcaggctgtttatgatctgcggcagataaaccaccactgaaacgccaataaaaggttcttccccaaaatcacagcttttcaggtggcttgcaccattgaaaacagaaatataatggtcgctcataatcatcgctggctggtcgctgaacagcatattcatttgcccatgaaagcaataggtaacttcaataaaacgatctttacattggatattcttttgaattggagttgtaatataaacattactataaacaatttcagcaccgggcatcacttcaaaactctgcatggtgcccttcccaaatttcggagaaattgtatatatctttgaatctttttcaacggaacagttaccgatcagctcatggaagaacagaaggtcattttccattctccgcaaagttctgcctcctttctgaccgcaagaaaaaatcgcgtagccgatgcagattgtcgggggaaagtaggtaatcttcctgctgttttccgttatccaaatgaatcactcttgtacaggctgccgctaaaaattcgtaatcatgggttacaacaaaaattacctttcccattttagaaagcgtttgaaatagccccgcaacttgaatcatgctgtcataatcaagtccgctagtcggttcatcaaaaattaaaacgtccttacggcataccatactgactgccacggccgcacgctgcttctgacccccggaaagtgtattgggatgatgagtacggtactcataaatacccagccgttccattgcctgttttgctgcgtccagatcaggatgcttaattccaaatacacattccttttccaatgtatcggcaaataactgatagcttacgtcctgcatcaccatataggagcgttttaaccggctctttgcgttcagttctttaccatcccaaagaatctgccccgtatagtttgtgtgcaggccgcatagtgttctggaaaatgtagatttcccggctccgttatgcccgataattcctatgatttctcccggcgccgcactcaaattcaaatcgtccagaaccgactttttcttatagaacaaggataagtttctgacttccaaaatcggcttttgagaattttcagcaatggcccttggctgtacctttgacaaatctaaagcgcgaagtcccatactgtgccgctgttcttcaggaatagaaagaaactggctcggagaaaacacagcagatatagccccgttttccatatacacaatgcggtcaactaattccctcagataataaatcctatgttctgcaattagaatggtcttgccttgtttctttaggagttcaagtgtacgccgcaaatcctcaatagcatccatatccagattggaagatggttcatctaacaagtaaatactcggagacatagcatagatggacgcaaacgccaccttttgtttttcaccgccagacaattcaaatatgcttctcccggtcaaatgggctatatccaaatccgcaactgtctttgaaatgcgttctttcattttttcccttggataagccagattttccattccaaaggagatttcactgtctgtatctacattaaaaaattgagagcgtggattttggaatacagaccccacatgctcggacacttcatacatgggataatcctgtatatctttaccgtcaacataggttgtgccggtgacttctcccggataaaagtatggaatcaggccatttacaagacgggtcaatgtggtttttccacagccacttcgcccacacaacagcacacactcacctttgttgattgttaaatcaacatcgcgcagtccgccattttgtaatgattcctgataggtaaaggaaaccttgtcaaaacgaatcattagcctgcaccccctttcaatttcagccagaccgacactgacataaacaaagtgaacaggagaaagcatacggcatccgcaatactaaagtggatttcctgcaagcaggttcggggcttcggattttccagcccccttgtaacagccgccgccgacaattcatccgccactttcagtgctgacatcatcatcggaacatagatacattccactgttcgggccggatgggtcagtagacttttgacggttggagcgacatcgcgcatccgcatggcgtctctgatatagccccagtcctcatgtaccatggggaaatagcggagcatgaccgtcatagggataaccattgctttgggcatgtgaatacggttcatggccgccataaattcatttactcttgtcgtgctgactaaaatacctccgagcatggcacagggaaagattttacggataaatacggtaaatgttacaatcgcaatctgcaaagtccctgtcaaataatttgttccaatgatatgcagaacaaccattcccgcatagacagcagccattcttaccgtaaaccgctttgctcctacaaggatgccgagaatcacaacgcatacaaccagcgcaatctcatagagtaaagagggcgcaaggaacaacgcaacatttccgacgatcaacagatatagttttgtgcgagggtctaaatgtaatgtggcaagtgtgtcctttgtttgcagttgcatctccattacactactccggccttttcaaaatgctttttcaatagtttctggcctacaagaccgctgatagcagcacagattaacacgccgataatcattgccgggagcatccagttttgtgcggttgaaaccattgtgtccatataggtctgctctgttcccttttctaccaaatattgcacataggcgtcgcggtcaaaccaaagcataccgtaggagaaaaccgggctgagaacaaagatcatgtaagacagcaggttacgccctttgtttctaaagttcccggaaccggccagcagatcggccacaacgccgagaatacaatatgccaaacacatagaccagtacataccgagtacgaacagcacacctcctaccaaaataccggtgacaatgattgggccatgcttcggcacctttgccagtatcagcatataaaccgggccgcacagcagcgcaatagacagcgggcaaaggaaagtcagtacagggaagaacccaaagatagcctcgccaatcatggcgcataccatgtacaaagcagcaaggatgccggtggtaatcaaatcacgcacagacagcccttttttcatttgttgtgaattagacattttcaaagtcctcctaattattatttactggcagaagcctcattgacctacgcacaaaatcgtgatagaattgctgtgattagagtcagctaaccagccagtaatgtcattctactcagtgattttttgggtgtcaaatccggcaaaaaaggtcaaaacaggagttaaaagtggaaaaacaaccggatatatcagtgctttttgtggttttgctgacagcctttgcgacattttggagcataaaaaaagatactgcggattattccgactacataagaaacgggggtgagcaggatgcagaccgattctacacaggccgcgcacgaattaggggatgcttctttttatctgcatgattatcattttcgacaggataatcataatggaatctgcaccttgcagccgcaaaacagacaaggctatggaaatatctatcaggttcaaccgacagatggattattcctgtcaaccggaagctggataccatacgcctcaatggaacgcaaatatgagatcaatcaaaagctggtgaaaatttattatttggaatccggcggtgttaccctgatccagaatgggcggaaagcccaacctatcacagagggaatccacctttatctaaataagccgtcacaggggcgagtattatatcaacccaatataccaatcagctatgcgtcagttttgctgtttgaagattacatagagaaaaatctgcaagaccgttttaccccggacgattttgactatgcagaggtttatgattggaaagcttttgattataataccccggaaattggaaccctgtttttgcagatacgggataaactgattgctggcgaaacctcccgtctttactacgaaagcaaagtaggtgaactgctttctattgtagcaggcaactttcataaacaacgacaggagatagcatctaaacaacagcctctttccaaacaagagaaaaaggcgctggaatctgtacgtcaggccattgaacagaatgttttgaacccgccggaagtctcacagctttgcaaaatagcagcgatgggacagaccaaacttcgagaatcattcaaagccatgtatggtgttcctattggggcttatatccgacaggcaaaaatgcggtatgcgcttttattgatgtcaaaaccgaatttgacaatcggcaatattgcagagcatttgggctatgccaatgcaagtaaatttgcggccactttccgtaaagtttatggaaaatccccagaagaatataggaatcaaaaaagatgaagtcagtctatttgatatgtacccagaattctggacacataaaaaattgaattaggtgcacatggatgcctctctgaattttgtaggaggcatccattttgttttctcttggattctttcgttgttgtagtaatttatgtagccgtcaacagccttggcaaatgtttcaaaagaggaatactctttttcatgcccgtagaacatctcgtttttcatccgtccaaagaaggtctccatgatgcaattgtcgtaacagttgcccttccttgacatggattgaatgattttgtgatctttaagtgcctgcctgaagtacacgtgctggtactgccacccttgatcagagtgaaagatcaggccatctacagagggaaacttcgtaaaggcgccggccaacattctctggatctgttccatattggcactttgagataaatcataagaaatgatttcgtttgtgttcatgtcgagtataggagagagataacacttcccccacgaaaaaccgaactgagatacatcggtagtccatttttgcataggagctgtcgtgctgaaatcccggtcaaggatattctcagcaaccttgccgacctcgcccttgtaggaatgatacttttcctttgggcgctttcctgccaaccccatagtgtgcataagccgttgtacccgcttatgattgaccttgtggccgcgctttatcagttcctgatatactcttcgcacaccgtagcggcctttatgctgtgagaaaatgtctttgatttcatctgccaagcaatggtttcgaacagcaacttgatcggccttgctcaactcaaaataataggtagaccgtgccatctgcatagatttcaacagatatttcaattggtatcctttttcacgcagctctttgatgatcgctgctttctcgccttgagttgcgctgcgtgcctctcttctctcaaggcgatctctttttttataacttcattctccgcctttatatactcgttttctgcccgaagccggatcaattcttctcgttcggattcattcagtggccttgcttcttcctttttcatttggggtacccctttacttggacgaccttttttcatttctaccaggccattatacccctttgttttatagttttgaacccattgatacaatagtctatcttgaataccggcctcgattgccactgacacacaggattttccggacattacttgggatactagttccagccgttcttctggtgtccagttcctgttgaaatttttgtgtttcagtgcttctggaccgcggctatcctctgctcttacccatagtctcactttatcccgaaaggatttatcgctaacaccttccggcgtttctggccattttccttctcgatacagttctacacatttccttttgtactcatatgtgtaccgcataataataccccctctactgggtgtccagtaaagggggtacatatcaatttacactaacttcgtctttttgattatattgtaatttattgttagggaatcagtcgttaatcaattctgctaatatgatttcttctgcctgcgctttcagcgtgttcatcagccccatccagcgcatagggtcacaggctttcagttcctccgtgacacccgcaacttccatcatgtgaggcaacatggtttccacacgcccctgtgctgtccgctcaatctctaacaggtgtggatacagcttctcgctcatcagcagatggttgtagagaatggggcgatgttcctttaggtaggattttcgcattctgccgtacttgccgatagaagtttccggctgttcagaaagttttaggttgggtatatcataatctccacaacgaatgtaagtcaacttactcatattcattctcctttgcttcgtgatgattagactgctgcgctggctgctatgctgcctttgcgtggttcttctttcggcagctgtccgacagtagaaaaaacgccttttttcatatcctcagcccggatcagggctttcttagcgtccatttccgcttttttcttcgccttgattttgtcctcatactgtttctgtgcgccgctggctttccgcttcaaataattctgatgaagcctgtccttgcgttcttcttttttctgcagttcttcctgttcctccggggttaaaggaaccggctgtaaggatggtgggatatagcgtcctaaaaaattgaagtagatttcaatttcctgcgtggtgtcctggctgccttttcgggcgcgttcgtggacaaggattttctctacaaactcgttgagcatggtgtttgtcagcgtgtcaaaattctcatacttatcaatcagggctataaatttctctgcggatttctggctctgctcatagccggtaacagccttttccagctccgcaatttcaatctcaagtgcgtcctgctctttggcatactgtgcatcaagcgccctatatcgtgcatccgacagcttgccgagggcattgtcctcatagattttgcaaatcagtttttccagttctccggttctcttttgagcagcagccagacgcctgcgctttttcgatatatcggcactctgttgagcaacctgcgtttcctgaacggtgtgaataaattccgtccggtcatttctggaatattcagcgatagcccggagcgtgtcagaaaccaatgtcagaacagcactctcattgatacggtgttgtgtagggcatagtgtcccacacggaactttggtataattggaacaggtatattgagaaatccgcctgccattgttgatgcggtggacatacatctttccgccacaatcggcacaatagagcaaacctgtgaggggagccgcttcgccccagccgtttggataacgccgtacattgctgcggattttctgcgccaaatcaaaggtctgctggtcgataatggcttcatgggtattctcaaagatcgtccattcatcctcagaaacatagtggcttttcttgtccttaaagtgcttgcgggtcttgaaattgatggtatgccctaaatactctcgttttttcaaaatgttcacgatggtagatgatccccatccataggggtctttgaccggctttgaacggttcacaccttcgttgaatcgggcaaggtgtacgacaggaatttcaatccggtctgcggacaacttgcaagcgatctgataaggcccatatccctccagcgtgagggaaaagatacggcgtaccacttcggcggcttcctcatctaccagccaatgttcccgcttttcatcccacaagtagccgtaaatcacggtgcctgtcaggtgcttaccgctcatgccttttgacttaaacacagagtggattttccggctggtgtcgcgggcgtaaaactcgttcataatgttgcggaaaggggtaaaatcatcatcgcctttcagactgtccacaccatcgttgatggcaatcagccggacgccgcgttgccgcaaaatctccatgacctggccgactttcagataatcgcgccccaggcggctcatgtcttttatgacgatggcctctacacgccctgcctccacttcctccatcatcgccaaaaatccggggcggtcaaaacgggtgcctgagataccatcatcggtaaagtgcgtagggttgggcagcccattccggcgggcaaaatcctctaacatctgcttttggttggatatggaattgctctcgccctgtaactcatcgtcccggctcaggcgctcgtacagtggggtaattttttcatttctcatggctgtacctcctgaaacaaaaatactctaagtgattgcttcactaaccatgacaaaatcatgattaagaagtcacttagagcatatatcacccgccgccagcttatatttggcatactgccgcacggcaaagtggccagggtcccgttctttcagctcgtcaaacatcagatcgacggcgttcttaaattcctcgtcgtcctcccgaacctccatggcgtttatcatctccagcagcgtggagaagttctgttcctcctccggggcctcgtagtggatgtagccgatgagtgccgtataaagcagcatctcggccttcagccagaaatcgtccccggactttccgccctcacccttggtgttgacaatgaggcagttcaccagcttcaaaatgtccttctcgctatggatgtacgaaaacgggttatagtggtgggacttcttgaagtttatggtgttcatgatcttgatgcggtagcccttgcgccgcagcattttcccgcactcaacgacgatactaccctttgggtctgtgaccacaaacgaacaggggtaggtctcgctgtcgcattgcatcaggttcggcttgagccagaaccgggtcttgccgctgccgctcccgccgataataaggaaattcttattccgggccgtcttggggtccttggggcggttgttcatggtgatctgctcggtctgcgtcaaaatggcgttattctcgaaaaccgggtccacaaagggctggatgtccttggccgttccccagcgggcgctcccatactccgtgccgtggcggtatttcttggcgtttttgcctttgatgtagactgccagccgcaggcccgccccacagcacaggcccaccaacagatcggaggggtgaaaactgggggcggcggactgaaacgcggtggcaaagccgtccatcaggtgcagtaccttgtccgcaaactccatcccggacgaaagccgccatgcctgccccagcttggtggcatagaggcccacgaacaggtacgggagattggggaggacatattttttcaagttgacctgtctcaccgctccagcaccttctttcgtaccttctccacggtgttccgggccatatccttgtactgctccagccgttccagcacggaggtccgggtctcccggcgcagcttccggcccatgtactcctgaaaggcggcggtgatggcgtcggcgtcgcggcccttgaagaagatcatgtacttgggcggcgatgtgctccgatccttcttgaccgcataatccacgccgtactttcgcgcaatccgctcaaattgccggatctccttgtcctgaatgtcgatattggagaccccttgattttgctgtgtgagctacttcaccgtctgcttgccccggtgggccaccggcatctcccgttttctctgcttttccagcttgacctccttgcggtaggccatatacttggtgatcgccgctttcagcagacgcccggtgaatttgctgccgttgacaatcagcatcaaagttttctgttccacgtcctcctgcatctactcacctcaccttcgcaggagtggggcggccccggagggaccgccccaggcggaacgcttatctcacttcatgccaggtctcatcctccgcgccggtgacgatggtgtggccgttagcggcctccatcagatcgtagtaagcccagtaatgggggttctggaggtcgcggaaggtggtcagctcgtcctcatggtgccggataaaacgctcgtccgccgtgcggcccaacatccggttgacgatggttgcgacctcggcgcgggtaatacagtctccgccgtggaacaggccgtccgtataacccacgatccagccgttccgggaggcctcctgaatgtagtctgccgcccagtgggaaacgggcatatcggggaagctgcctcgtctgctgtcgtaggtctccagctccatccactcgtccagccggacgctcatcgccacaaactgctcacgggtgatggtggcctcggcatggaacaggccgtctgggtagccaactactacgcccagcttttccagataggccacatagtccgcgtaccacgcatcccggcgcacgtccgggaaccggctgcgccgcaggccctccaactcgtccccccgcgcttcggagaggacgcgggcaaatacggcggccgcctcgccccgcgtcatattgcggttcgggccgatggtgccgtccctatagcccacaaggtaggcaaagtgataggcggcgggaagcgttaccttgccctccttgccggtctcaccggcggcggtggtgccgtctccatcctccacggtgacagagacgccgggcttcgcctcgccctggttgtctgtgatggtgacggttacagggccgtcctcgtcaaaggtaaaatcgtccggcagggtgacggaaaccgcgccgtccttgtccacgccgatctcagcgccgtccaccggcttcccatcctggtcggtcacgtccacgttgacggtattggacttgtcctcgtccccggtgtccgtgccgatgatctcaccggcagagccggaggcgtcggggaccgtgatctgacccttcttgtcggtgtctctggccgcatggttgcgctgctcgtcggagacctccacattcaggcccgtggcgggcttggcggtgggcaggaggaccgtcaccaccgtctggtcgttgccgtccagcaggcggccgtccggcagcagcacagtaaaggcgtccttttcgccgtcctcaccagccagcagcgtcaccagcgcgtcttttaccggcttttccgctgtatcagtgacgattacagtgtactggcccaccacagcggtgccggtatcatcggtgtaggcgctgtcggcggcggggacggtcagctcgccgtccttgttggtctgcccctgggctgtgccgcccaggtcgctcttgacaattacggtgacatccttctgcggggcggtctcctggtcggtgacggtcacggtaacgcggtggcggctgtccatatcctgacccttgggcagagaaacggtgatatttccggtcctacccacgcttaccgcagcgtccgcgatgggccgtccggtctcggtgcgctccacctggacggtcagcgtccagcggttgccgtccgcgtcctcatagcctatcgtggcatcgccgtcctcattggtaatcccggaggaaccgggggctgtgaactgacccaccttgtccgtcttgccgccgcagtagttggcgttcttgtccgtgacggagaccgccagctcctctacgggggtctccggttccgccagcagaacagtgatggtagtctggtcggcatagtccagcagacggcggtccggcaggcggatggacaggtgctcctcgccgcccagctccaccgccgcaccggagaccggggccttgctgtcagtgtcggtgacgatcaccagatagcggcccaccacagcctcgccgtgctcgtccgtggtgctggagacatacagcttttccagctcctccgtctccagcacctcgccgcagaccgtacactccttatgacggctacccgcgctgtcctggtctggctccttgtccacgatccactcacttggcgtatggcccgtggggtcggtgtaggccccgtcgtaggtatcgccgcagcgggaacaggtgaaggtggtaaagcccatggccgtgcaggtgggcgcggtcacgtcctcctgatagtcatggcccaaggcgttttcaatcacagcgccgcacttggtacagagctggggggtggtgcaggtggcagcgtcgccgggaatatggcccgcagccgcgtctccttccaggcgggtcgcgccgcagcgggtacaggtatattccatgatgccctcgccggtgcaggtggcgtcggtaacaagcgtcccctcgtcccagctatggcccagtggctccgtgtagtccgtcacgaaggtggaaccgcagccagcgcaggtgtggatggtcttgcccccggtctcacagtctgccgggatggtcttggcggcatagtcgtgggacagcgcaggggtaaggtcggtgatgtgccggtccccgcagactacgcactcgttcagggtatagccgggactggtgcaggtggccgggagcacctgcgtctcatactcatgctccgtctgcgggatggtgctctccttgacgttaccacaccgctcacagatgtccatggtcttgcccggcgtctcgcaggtggcctcccggaccactacgctctgataggcgtggcccagggaatccttgtagttggccttgaccatcttgccgcactcggtacacatcaggcggtcatagcccagggccatacagctgggggccacagtatcatggcagacaaagtgatgctcacagtcctgattgcagcaacccccatcacaatccgggtcctggcagtcgcagtccgggtccccgcagccacagccgcaggagccgtccgccgtggcggtcaggtggacataggccacgccgtcctccaccatatcggtgtccgcataggtgtaggtgatctcgtagtagacagtgtagttgcccgcctcggtgtagttgggggcggaggtcagggtgcaggcgtcggcgctgtgcccgtagcggacggcggtggtcacgcccgcctcggagagatcggagacggtaacagtgtggggcgcgccgtccgccacgccgtagtagtccgccacaaccgctttggcggcggtgtaggatgttttggcatagccgcagtcggcgcaggtatccatttccacaaaccgctggtgggccagctccggccggatgctggtctccatgtggtgacgctccagcgtggcgtcctctgtgtggtaggtgccgtaacagaagccgcaatactggccgcccgtggtgataacacggtggtactcccggtctacctgctcaatctcgacgctctccggcaggtcctcaaagaagttggcggcacagtcaaaaagccaataaacatttttgtcataggaataactgtatgttcccatattggcattgatagttccacaagattggcaaactgcctttgtccaatgataacctgtaaaataggcatccactccaggggtcccgtcatccaagctgccatgctgttttccgtccagcattgtcccatctgaaaacttaacgcctcgattcagcgccgtttcccctgtacgggtatactctggagtacgatagacgataaaatctctcgcctgattgcaataggcacagtcgaaggtctcgtgggtcacaacagcattggcatccaactcgttggtacggtccaacgcctctttccaattctcagcagggtcatgatagctgttttgttgagcggcagatgccgcaggtaccaaggaaaacagcagcacgacggccagaaagcccgccaacaaagagcgggcgtaacggtatcttatgcgcatgttcattatcctcctttgtgggtgaatgggtttggggttaggtagagtaagccaaggcgctaaggcgggacccgcagccgccgcaacaaacggcagtgggtcaatggctccgcccctgtcccttgacggtgagaatcccgtccagcgtggtggcggtgatccgcaggcgctcggcggtggcgatgtcgtttttcactgtctcgtccaccttgccgccgcagaccaccagcacacgggcgcgccggaggtagtcgcgggccatgtcgatgctgtccttgtgctcctgggggatgccgtcctccaggaacagcggcaggaacagcagggggcagaccggggaaaaacccgcgtcgtacacctgacggcaccagcgggccgcgttctcggtgttctcatactcgttctcgccccagggggcggtgatataggccagaggtcgtttcatggcaaatcctttctcccagctattccgggcataaaataaggcggcctgttcagccgccgtagtcgtggtggaaatcgtggttgaccagcatggtgtagtggttatccgtggaactgggggcattgaacagggcggccagcagataagccttggcgttccagacgcgggtgttgttctcgctgatgccgtccagaaccttctcgatatggctggaggtgatctgctcaaaccgctgctgcacaaaggcggtggggtattccgcgtcccgtccgatcttgatggtagggctgcgggtcatagccacctccagcatcagctccacaaactcgtccacctgggtccggttgaccggagtgcaaatcaggtcatactcgatctgttcccgaatttcctctcgcttctcatacacgtccttcattccttccagctcaggtgtggaaagaacgaatgaatgagtatttgatagatgcgtatttgatttttgaatatttgatctcttagtatttaattctgcgggcttttccgtagatggctccaccatatccggttccaccagatacgggaaagccgtatctggtgcgcccgtatctggcggggtcgtatctggtcctggttcctctggcggttcctccgcaccggggcagggcttttcgtagatggtgtactccgtgtcgctaatgcgtcctccaggaccgcgaagctggcggcggacgatgtagcccgccttttccagctcacgcagcgccccgccgatggcgtccacgccctccttgcagatggccgcaaggccccgtgtggtgtaattccactcgtccggcagggagagcatcatggacagcagccccttggctttcaaactcagggctgtgtccttcaggtggtggttgctcattacggtatagtccagcgtccgttctatgcggaaaactgccatgttttgtcacttcctatgtagcgtcgttaggagcattgggctgaatggaggcggtctgcccgtcctcacgcgcaaaccgttccgccaaacgcgccacactccagctttgtttgaattgtcccagcgggccggggccgaactgtgtccgcgcacggttatccaaatccagcaggcgcgcccacagctccgggtgatgatggcgtagatttcgcaactccccaatccgctgaaaggggcagcaccagcaggaggcgcggtggtagatccggtacaggccgccgaagtcaaagccccggtcatagcacagttgtagggcctgggcctcggtgatgccccagtccaccagaggatagtggagatccttgcagcgatgggcctcgtccgccgcgatacccacatactgctgaaggcggtgctggcccttgagacgggtcaactccttgttgatctggtgggtcttgagctggccggtgcaccagcgaaccttgatgcccggccagccgttgccatagggcggaacgcctaaccgcgcccggttctccagggtggagggcttctgtttgggctcgtcaaacatcatgtactcgaagctcttgggagagcgcagggtggtgatgtgtagcccccgctctcggtacagatgctcgtccaccttggagatatggccgtacatctccgggaactccatgccggtatccgcccaaatcactgcgtcaatgggcaggccgcgctcgatcatcagcagcaggagacaggtggaatccttgcccccgctcaaactgaccgcgtgaaaattctctttggcggtaataagagcgcccatctagggcacgtccttcttgctgacctccttctctttttacagctcgtagaccggttgctcacactcgaagcaggggccgcacagctcgtccagggtatctgacagatcctccagatccagacacatctcgctctgcgccgcatcccccttgatggtgcggtactcggtgacgtattcgccgccctcatattccacacgcacacaggccacgcagacaaggctcatgtcctccagcagccacagctccagcgtccgggtggtgacggcaatctccatcgtgctctggtcgtcctccacatacagaagggtggccttttgtccaaacagctccgggccgcgatagttgaaggacttctcctgcatcccttgggtgatataggtgtacgccgttcgggctttgtcctgcacagcctgggtcagtgcatggaagtcaatattacccaggtagtccatggcgtcctccgcagggttcccgtcctctaatatccgggtacggaacagactggtaagttcttcctgcaaatactttaccttatacacgataattccctccaatttctgttaatgatgtttcttcctcttgggtcggatgatatgcccctccacaacaagggcatggtcggtaatatggattttccccagctcctgactatggagcactttctgatacccttgttcactcaggaacaggcgggccgtctctccgcgcaaagcgatgagattatcgtcctctaggacttcaaactcgaccatatagcgggtatcgtcccgaaaacgttctacggccagcaggtcatgtccccggatagtgaaccgcgtcatacacgcgccctccgtgcccgaatgtccaacacaggcaggccataccgggcgataagggtggcattgacgatcatacggaacacttccgcgtccacaatatctgggtctgcaagctccatcgtcgcggggcctccgacaccgcgatacaggccctttgccgccgagattagcgcgtagtcatggggggagataccgcctagtaccgcataggcaggttcgaagcccttccggtaaaaacagttggcactacgtttccacagctctgcgctggaggtcagcaggaacagggcggcataaaaggccggagtatccctgcgtcggtagtagtgcagccgggtcttggcatattccatgcgctccttgtgtgtcccgtccttccacagactcccaggaaagctggcgaccagggcacgcagacgcggtgcaagcagtcggttccggggaatggtagccatcaccgcctcctgataccccaccactccggcctcaatccgctcagccaaccagggacagacaggaagcgtacacccctgtttctgcttgtattctgtgcaaaggtagcaggcaacgtgctttggtctatagcgaaatgtgcagacaaacataatgacctcctgattttgggcacaaaaaaaccggatcgcaaggtgcgtccggtaacttgtcgtatgtaattagcgatcttggctgcgttggcgctttttctgccatgcctccagcagcttgatgatggtctcctgcatccgtttgggcgtgtaggagcggggaaagtatttgcggatcgtgtccgtggaaaacgtcagcttttccgcctccgtttttttctcctcggaaagcatctcccgcattgtctcccgcgtaagtgtcccttccttgctggcttttctcagccgctgggcctgagagagtgacggtgtattctgcgaatatgccattgcatccagcaaaagtgcctgctcgtctttggcgagggcggcaagctgataagcgacagataagccaatttcttgagtatctaccttgtccatgagttcctgccgcagttctgtaagctggatataattgcgcagggtgtccccactgattcctagggatttcccaatctcatcgtcgctacggaaatttgccgaaattttcggcaaatttttggcaggtcgtcccgcctgctttttttccgcctccaaatacatacgataggcccaggcacgttcgctgggcaggacgttctcgcggtatacattgccatctaccatctcggacacagcctcctcgtcactcagatcccggataatgactggtatctctgagtattctgccagttcgctggcccgataccgccgatggccgtctataatttcataccccccctccggatccgggcgaacaagtacgggctgacgtacaccacgcgcctttacacgggcaataagccggatcatagatgggttctcctcccgtacaaagtacggctgtttgcgcggcataatgtttttcagggcgggatagcccttgaatgggtgcagctcgtttaatctcactcggataattttttcctcagcacgtctatctggtgcagcgtcatcggtcaactaggccaccttctttccaataaaaaagagcacttccaaatgaacggaagtgctctctggttcaaatataaagagggacttgcaatgcaagtccctctttgtgattttagatataaacgtctacgaacaaatcgccagtccactgactttgacgggttaaggaaaatccgttcactttttggaagcgtttcgcctcttcaaagcctattttcagtgaaaatacgaatattttagttcgctctgggatgtttgatagcggcctgggcggcagccagacgggcgataggcacgcggtagggggagcaggacacgtagttcaggccaaccttgtggcagaactccacggaggtgggatcgccgccgtgctcgccgcagatacccaggtggatgtcggggcgggtctccttgcccagcttggcggccatggcgaccagcttgcccacgccgttctgatccaggtgggcgaagggatcggactcatagatcttcttgtcgtagtagtagctcaggaacttgccggcgtcgtcgcgggagaagccgaaggtcatctgggtcaggtcgttggtgccgaaggagaagaactcggcctccttggcgatctcgtcggcagtcagggcggcgcgggggatctcgatcatggtgccgacctcatacttcatgtcgataccggcgtccttgatgatcttgtcggcggtggcgaccaccacgtccttgacgtacttgagctccttgacctcgcccaccagggggatcatgatctcgggcaccatcttccagtcggggtgcttcttctggacgttgatggcggcgttgatgacggcggtggtctgcatctcggcgatctccgggtaggagacggccagacggcagccgcggtggcccatcatggggttaaactcgtgcagggaggcgataacctcgtgcaggcgctctacggtgacgccgatctcgccggcgatctccttgatgtcctcctccttggtgggcaggaactcgtgcagcgggggatccaggaagcgaatgacaaccgggcagccctccatggcctcgtacaggccctcgaagtcgccctgctggtagggcatgatcttggccagggccttcttgcggtcctcggtgttgtcggcgacgatcatctcgcgcatggccttgatgcgctcgccctcaaagaacatatgctcggtgcggcacaggccaatgccctgggcgccgaaagcgcggccctgggcggcgtcgcggggggtgtcggcgttggtgtagaccatgagctgacggtacttgtccgcccagcccatcaggcggccgaagtagccggagccggggtcggcgggcacggtggccacggcctcgccgtagatgttgccggtggagccgtccagggagatccagtcgccctcgtggtactccttgccggccagggtgaacttcttgttctcatagtccaccacgatgtcgccgcagccggacacgcagcaggtgcccatgccgcgggccaccacggcggcgtgagaggtcatgccgccgcggacggtcaggatgccctgggagacctgcatgccctcgatgtcctcgggagaggtctccaggcggaccaggatgaccttctcgccccgctcgtgccactccttggcctcctcggcggtgaacaccacgcggccgcaggcggcaccgggggaggcggccaggcccttgccaacgacctgggccttcttcagggcctcggcgtcaaaggtggggtgcagcagggcgtcgagctgcttgggatcgacgcggcacacagcctccttctcgtcgatcataccctcgtccaccagatccacggccaccttcagggcggcggcggcggtgcgcttgccgttgcgggtctgcagcatatagagcttgccattctcgatggtgaactccatgtcctgcatgtccttgtagtgcttctccaggcggtcggcgatggcggcgaactgctcgtacaccgcgggcatctcctcatgcagcttggagatgggggaaggggtgcgcacgccggccaccacgtcctcgccctgggcgttgatcaggtactcgccgaacagggccttctcgccggtggcggggttgcgggtgaaggccacgccggtgccggagttgtcgccggagttgccgaacaccatggactggacgttgacggcggtgccccagtcgtaggggatctcgttcatgcggcggtagacgttggcgcgggggttgtcccaggagcggaacacggccttgacggcctccatgagctggaccttgggatcctgggggaagtcctcgcccttctccttcttgtagaactccttgaacagaaccaccaggttcttcatgtcctcggtatccagctccacgtcctgcttgacgcccttcttggccttgacgtcgtcgataatctcctcaaagcgcttcttgctcagctccatcaccacgtcggagaacatctggatgaaccggcggtaggagtcgtaggcaaagcggggattgttggtgaacttggccaggccctccaccacggtgtcgttgaggcccaagttgaggatggtgtccatcatgccgggcatggaggcgcgggcgccggagcgcacggaaaccagcagggggttctcgggatcggcgaacttcttgccacagatggcctccatcttgcccaggtactcgtagatctgggcctggatgtccgcgttgatctggcggccgtcgttataatactgggtgcaggcctcggtggtgacggtgaagccctggggcacgggcatacccagattggtcatctcagccaggttggcgcccttgccgcccagcagctcccgcatggagccgttgccctctgagaacaaatagacatacttatgcgtgttggccatttgtcattcctcctagatttacgttgcactactatactcaaatacagtaaccggagacattataccattttgccaaaagattgcaagagatacccgtcggttttctttctcttttgctcacttttcgccactttgggcgcacggaagtgccaactggcttcattttgctccagccgtccccgccccgaccggccgcgcataaaaaatgtccgcagaagcggacatcgtgtttttaaatgtctacattatcaaacatgtggatgtttagtaaatatatcatttttgcaggaaaattgcaacaggctattaatatattttacaaatttatttcctaaatcttcctatcgcaaaatgttgtatcctcgtttaaaaaggtagacatttacaaaaaggaggatacaccatgagacatcaaaaaaaacggtggtttgccgcattattatccttatgtatgttactatctattcttccttcaacttctatagcttttagtgaaagcgaagagacctggagtgggaacaggaggaagcagaccattgatggcggaacccatacaattacgcttagtaatcttactattgactcaccgggcgttgagaaatctgctattgatataactggtaacgcagatgtcacctttatactggagggcaacaacactctcagaggttaccggaatcatcctgccatctgggtggagtccggttcctccgttacctttgaaggaaacggattactcgaggcctccgccggcggggcatccatcggtttaggggcggccggaatcggcggtggatatggcgccagcagtaattttggcaatatcaccatcaacggtggtaccatcattgcccgaggctccggaggcggcgcgggcatcggcggcggctacgaggtcggcagcgggactgtaaccggcaatgttaccatcaacggcggatacgtcacggccatcggtgggtcaagcggcagtaccggcggcgcgggcatcggctccggtgagaacgcaaactatagcggaaccgtcaccatcaacggcggtgtggtatacgccgagggcggtgcggactccaccagcatcggccgcggcaaccgtgctatcggtacaagcgacaacggagccttcaccaccggcacgggcggaaacgccgtcatcgtggccccggacggcattggggacccctccggcttcgctgactgggacggtatttttatcagctatgagggcaataatacgagcgcgacggtgggtgaggacggtacggttcacctgaatgacacagaggccaatatccaggtctggggtgaaccggtgattgactatccgcttgtggtggaaagcggcaccgagctgcgggtcgtccagaatgaccgaaactacgcctacgccactctggaaatcggccaggacggcaaactgaccaataacggcaccgtcaccgtagacgagggaagcaccctgattctgcgggaaggtcttgaccagacagatggcagcggtacactggaatgcaccggcaccgtcaaactgcccccggaggataagctgattgccctgtccggcgcggaggacctgacctacaacggcacggagcagagccccgaggtaagcgttacattaaatctgtggggctattcccatacctatgggaatccggcggactataccgtaacttacacagatgccacaaacgccggagagaccgccaaggccgttattacctccactggtgccggcgacctgctggcgggcagcgcctccaagacctttgtcattcaaccggccgcttatagcattaacgtgtccgacgggaagtggacagtggcgcatggtgaaacgcagctcctgtccaagctgccccctgccaccatttccattgacccgtcgattcaagatgacctgaccggcctgagggctgggaacctgacttggtatatggatgagcaacattcgcaagcggtgaccgatacctcccttcagaatacatccgccggcgaagaggtacccctctattgggttttcagccacagtgattccaattttgcgccagagtccaagtccgggacactgaccatcacgattaccaatctgcccatttatccggttgtgatccggcagggagatgaggttgttacaaatggtaccatcaacaagacctatggggatgaaaacttcactctaactgtcgaacttcaaaaggatgatagccttatttctcctgatagtctcgttacctttgctagcaataatgaagatgtggtaacagtagccccgagtggtgaggttaccatcaccggcagcggaaccgctgtcattaccgccagcgtggcggaaaaaggcggagacgatggctatgccgccgccagcggtaccgtcaccgtatctgtggctcaaaagccgatttccgtggatgacagcaccgtgaagctgaacggtcactccagtccgtatacgtggccctatgatggacaggcgtcggttacagtcgaggccgaactgacccaagctgacattgtgggcagcgatgatgtggatgtgaccgccaccggaacactgagcaatgcaaacgccggcaatcggtcggtcaccattgcttacgcgctgaccggcaccagggcggcacactatatcctgagtccagcccaagacaccaaaccagtagtcattaccaaagctgaccccacccaggccggtattgccgccaaccccggcaccttgaccatcgccaaccgggccgccagaagttattcctttgatcttcgcactttgaatccggataacgccactctcggcattacctcgtatacgaagggcgacataaagttcgagtccggcaaggagtcctattttacctcaaacgatgtaacgatcacaggcaatcttctgaccttgaaagccaacgctgtggacacacaggataccggaaaggtggccgagatccccattgtgatccgcagccaaaactacaccgacttcaccggcaccatcacggtcagcagcaaaaatctccatatcctgacctatgatcccaacggcggcagcggcggccccggaacggagctgctggacacccagaccggctacaccttgaagcagtcccccgtccccactcacgaccagcaggacggcgtggatgtgctgtttattggatggacagcgaacaccaccggagacaagatctacaccgccagcgatacagcgcccaccactgttgccaccgtagacatcaacggcgacacgacggtttacgccgcctggggcgtggataccaatggcgacggcgtgccggacgtgaacgagaccggcaagtacaagctgacctacgccgaaaacgagctggagaacggcaccttgcagggggttctgcccaccgacagcggcacttatgtcaagggcaatacggttgccctggccgacggaagcggcctcagcctcaccggaactacaaccagcgacaagggaacggcccgtttcgtgggctggtccaagacacagattgaccgcattctctcgcagggtgacaccatgcccgccggtgttgtggagcaggtgaccttcaccgactccagtatcaccgtatacgccgtctggggctgggacaccgacaacgacggcaagcccgacatcactcagaatccctccatcacctcctccgcgggtaagaacggctccatcgccccggagggcaaggtctatgtcccggccgggaacagccagaagtttgattttactccggacaccggctatgccgtggaccggggcaccatcgacggcacggcctatgtcaacaacggggtcaacctgctgcccggcatggacacctgggaaaagtgggaatcctataccttcgccgatgtccgggaagatcacaccatttctgtgaccttcggtgaggataccaacaataacaacgtccccgacgccaacgagggcaccgtcaccctgacctatgacgccaacagcggcgagggctcggcccctgccccccagagcgccaaaaagtggaccgccgtcaccgtggcggaaaacaccttcacccgctccggttacagctttgccgggtggaacacccaggcggacggcagcggcgaggattatgccgccggcgacgccttccagctcaccggccaggatgccgtcctctatgcgcagtggagctataacggcggcggcagcaccggcacgacccggtacaccattgaggccagcgcgggccatggcggcgggatcagcccggacggcagggtgcgggtgagccgcggcagcgacaagaccttccgcatcacccccgatgccgggtatgagattgccgacgtgctggtggacggcgagagcgtaggcgcggtggacaagtacaccttcgagagcgtgcgtaaggcccacaccattgaggccctcttcgcgcccgaaaagcagcttgccgacccggacgacaccggcgtctccggctggctgaacaccgaggatcacctcgcgtacctgaacggctacggcggtggcctcttcggccccgacgaccacatgacccgggcccaggcggcccagatgttctacaacctcctactggaccaggaggtgtccgccgcggtccgcttcaccgacgtgcccgccgacgcctggtacgcccgcgcggtggagaccctggcctccctgggcatggtggaaggcgtaggcggcgggaaattcgcccccgagcgcaccatcacccgggcggagttcacggtgatggccatgcgctttgcccgcctgcccgagggcggggagaatccgttctccgatgtgacctcctccgactggttctacgaccaggtggtgggggcggtgcagtacgggtggatcaccggctacaccgacggcaccttccggccggaggccaccatcacccgggcggaggtgacggccatcaccaaccgcctgctggaccgggcggcggacgaggactacgtggacgaccacgccggcgagctgcggcagttccccgatgtgagcgcctcttactgggcctaccacgacattgtggaggccaccaacgcccacagctaccgtgtctatgacggcgaggagcactggatgtaagtacctcctgatcttcctcttccatacaaaagcgtcccccggaaccgattggttccgggggacatcttttattcccgcttgtccaggggaaacaggattttcaggaacagcttttcggccgggccgccgcggatcagatcaaagctgcgcgccgaaccgtccggcccggtgacggtaaaccggcccgccccgttgaccaccgcgaagcccagggcttccagggtgagctggagggtgagctcccactccagcagggagtccaccgccccctcccggtaggcgtcccacagccactggaattccataggctgggtcccgtcctggaggaagccgcgccacagcgcctccttctgccgggccgagagggcctccagcgcgtccagcacaccggcgtcctcctcccaggccaggtaggcgtagcggctccccgtggggcggcggaccggaaggccatcccccaggccgcggcccgggcgggggtgtccatctccacatggaggcacaggccggtgagctgctcaaagggctggcccgacacggagcgcaggcggatgacgggggcgccgtcgctccggacggcggcccggagctcgccggtctcccggcgggcggtggtgccgtacaccgtcacgggccaaaggccctccagccccgccagcgcgccgccgcacacctccgccagatcccgccactggaacaccgtgtccgggtagaagagcagcagcaccgggctgtccggccgctggagcaccgtaggctcgcagtcaaagagctgtcccacatcccgcatcaggcccagcagcgccccagggcctgccgctcccccgggccgcagtccggggagccggtgctcccctgcggggcggtagggatacagcatggcctctcctcccccgctcatgcctcgctctccgccccggcctcctcgtcgggctggcggatcatccggtagcccacgccgatgtgggtctggatgtaccgggggtggctgggatcgggctcgatcttcttgcgcagcgtggccataaacacccgcagggagggggtgtcggagggcagggcgctgctccagatcttgttgagaatgtagttgtgggtgagcaccttgccggtgttctgggccagcaggcacagcagcttgtactcgatgggggtcaggtggatctccttcccgttctggtaggtgcagccggcggcgtagtcgattttcagcccgccgttctggtagatgctggccgcctcgtccaccttctcgctgtcgtagcgcacccggcgcagggacacccgcagccgggccagcagctcctccaccgagaagggcttggtcagatagtcgtccgccccggcgtccagggcctccaccttgtcgtgatcctcgctgcgggcagagatgacaatgatgggggtgttgctccaggtgcgcaccttcttgatgatgtccacgccgtccatgtcgggcaggcccagatccagcaggatcacgtcgggccggcaggaggccgcctccagcacgccggaggcgccgtttttggcccgccggtactggtagtgctgggtctccagggtggtggaaatcaggttgccgatggcgttgtcgtcttcaatgatcaagatttgaggtttgttcatcggtgttcacctccgcaagtggtagtgtaaagctgaagatagcgcccttgggatagttgtcctccacggtgatggagccgccgtgggcctgcacgatggagcggcacagggacaggcccaggcccaggccccgccgtccgtcgccccgggcgttgttggctgtgtaaaacatgtcgaacagcttggccttggcctcgtccgagatgccggggccgtcgtcggcgatgcgcacctccacgctctctccccgcttccgggcggacacctggacatgggagccggggggcgtgtatttgatggcgttgttgacgatgttgatgaccacctgcacgatcaggcgggcgtccattttggccatgagcatgtcgtcaggcagctccacggtaatggtgtgctccttggccttccggtccaggtgggtcagggcctcctggaacacctcctccagcagctccggctccatcttcagacggatggtgccgttctcaatgcgggagacggagagcaggttctccaccaggttggccagccacatggagtcgtcgtagatagaggtgtagagctgccgccgcttggccgcgtccagcacggaggcgttctccatgaggatgcccgcgttgcccgaaatggcggtcagcggggtgcgcagatcgtgggagatggcccgcagcagattggcccgcagggcctcctgctgggcctgctcctccacccggtgcttctcctggcccagcagctccttctccagcaccaggccgcactcgtccacgatggccagcatcaggtttttctcaaaggcgtcaggctcccggccctcctcgatggcaatacccgccaccgccagggcgctgccctccccccgcaccgccagatagaggcacttggcgttaggcagggtgttggtggtggcgccggcgtgcttgttgttcttctgcacccaggaggccaccgccgtctcgtcagggcccaggtatgctcctgtgtccacagtgggctccacagggaagaaccggggctggcccagggtgccgtcgggcagcaccgggtagtacagggccgtccgctccagcagcttgcgcagttgtaccgccatggcctccagaatggcctcctggccctccgccttctggagggtctggctggcctccagaagcacctgggtgcggtaggcctgccgggaggccagccgcgcctgccgcttgatgcgggtggtcagcgagctgctcaggaaggccaccaggaacatcaccaggaaggtggccagatagctcttgtcgttgaagtggaaggtgaacagcgggacggtaaagaagaaattgaagataagaatggacaggatggaggccgccaggctatagagccgcccgctggtgaccatggccaccaccagcacgcccaactggtagatcatgatgatgttggcctcgctgaagtccagataggcgaaggccaggcccaccatcgtgcacaccgccaggatcaccagggtgcgcagcgcgtccttgacggtgaaccgctcgctgaggttccagctcttccgcggcgcccggtaggcggggtaggtgtccgggatgatgtggatgtccagatcgggggccagggcgttgagccggtccaccaggtttttgctccgctcccaaaagaagcgcttgttattgctccggcccaggacgattttagtcacgccgctggcccgggcgtactcggcgatctggaggggggtgtcgtcgccgtacaccgtggcgatgcgggcccccagctcctccgccaggcgcaggttggcccgcaggcggctgcggttgtcgtcgctcatgtccttgaagtcggaggtctccacgaacagggcggtgaagctgctgcggaaggcctccgccatgcgggccgccgtgcggatgacattggcgttggacggcgcgccggacaggcagaccaggatgtgctcgctgctcttggccttggtgcccaccccggtgtccgccgcccggttgagccggtctgcggtgcgccgcagggcgatctcgcgcagggcggccagattcttcagggtgaagaagtggtccatggcccgggccgcctggttgggccggtagatcttgccctccttgagccgctccagcagatccgccggctcgatgtccactacctcaacctggtcggcgcggtcaaagatccggtcgggcagccgctccgccaccgcaatgccggtgatggaggccaccacgtcattgaggctctccaggtgctgcacgttgacggtggtgtagacgctgatgcctgcccgcagcagctcctcgatatcctggtagcgcttgcggtgccggctcccggcggcgttggtgtgggccagctcatccaccagtatgagctggggcttccgcgccagggccccgtccagatcaaactcccgcagcgtgatattcttataggggatctccttgttggggagctgttccagcccgtccagcagagccagggtttccggccggacgtgcggctcgatgtacccggccaccacgtccacgcccatctccttggcgtggtgggcggcctccagcatggcgtaggtcttgcccacgcccgccgcataaccgaagaatatcttcagctttcccgtcctggtctcctctttcagcttgagctcccgcagcagtgcgtccggatccggccgctggtccgtcatggttcccgcctcccctgcataaaattttacattatattatatcacagcttttgttggaatttcgctgcctttttcactttcatataaagattgcgttaagatttcgccagggcatgcgctcacgctcctttacatataaatgaaaaaacggcctatttgagaagggagcggatttttgtatgaagtgtttgatcctgcggcgccggaccctgaccgtgctggcgtgcgccctgctggcggcggccatgtttgccctggtcaacgccccggcggtggcggaggcctccgccaccgaccggcagcttcccatctactgcgttcagcgggaccagaagatgctggccatctcctttgacgccgcctggggcaacgaggacacccagcagctcatcgacatcctgggaaaatacaacgtaaaggccaccttcttcgtggtgggggactgggtggacaaatacccggagtccgtcaaggccctccacgatgccggccacgaggtgatgaaccactccaactcccacgcccacatgtctcagctctccagcgaggcgatcgtcgccgatgtggaggcctgcaacgacaaaattgaggccgtcaccggcgtgcgccccaccctgatccgcccgccctacggagaatacgacaacaatgtaatcacgtccatccgctccatcgggatggagcccatccagtgggacgtggacagtctggactggaaggatctccccgccggggagatcacggagcgggtggtgagccgggtccagcccgggtccatcgttctcttccacaacgccgccctccatacccccgaggccctgcccgccatcctcgaaaccctgctacaggagggctacaccttcgtccccatctccgagttgattctccccggggaatacaacgtggactacaccatcgaccacaccggccgccagcttccggcgcagccatcgtcatccccccgataagggttcgctgcccggaccttcacctgtgcagccccagcagagcctgatgccgcagatgagctattgattgctccgcgagcaatgatgtcgtcttactcatcggccccaggattccccgctgaatgtatggcgcgctttcaggcgaaaatcgaccggcgggaacgggcggcccttttatactgctgataagcatacggtttttacatctcttaagccaggcccccggagcaaaatgctccgggggcctggctttcgctcgggcatatgcccgagcgaaagccctccataacttttctgaaggtaacccttttgttttggaatttctctcacatgataagctttggtataatgaaattgcacaaaacaaatcgtatatattcttataaagattgggagtgtgcctgccatggaaaagagaattgccgttttgcgcggggatggaattggtccggaagtcgtcaacgaaagtatcaaggtattggagcgggtcgcacagaaatttgggcacacgttccattattatgatataatcggcggtgtcgccggtctggaggcctacggcgatgccctgcgtccgcaggattacgagctggggcgttcctgcgacagcatcctgttcggctcggtgggtgatccccgcaaatacaccttcaccggcgccaacggcaccaaaaaatacccaagccgtaaggaggccgcagtgaaggccctggcttcgttccggcgcggcatggagctctttgccaatatccgtccggccaaggtctatccccaactgatccaggcctctccgctcaaggatacggtggcccgggaactagatctcattgttctgcgggagaataccgcgggtatcttctatgcgggcaagtataggaaggagaccggcggcgaactgaccgcctgcgatgagtgcgtctacacctggtcacagatcgagcggcacgcccactgcgcgtttgacctggccatgggccgcaaaaagcacgtcacgatggtaaacaagcccaacaccaaataaagcacttttagcaaaaagaattttattatgtagtttgtttgccgggaaagaaactggataaaagagaaaatgtcgattgtcttgaagatggggcgtattttcaaccagcctgcccggatttctccacaagggagagataagtagcagaccgggagcgccgatcttcctcactctccggctccagataaagggtctgaaattcctcaaaggaaacattaaattcaatgtccacctcatagccgcgcttgacccggaccgctttcacaaactgcgccgcaatcattttctttgcctcgaaggagcaattatcatacaaccccgcccaatccattaactgggcgtactcctgccgcacctgttcagcgccggaaaggacctcgcgcagttcggcttccgctgtccgtatttgaccttccaattctgccatttgtacggtagtctcctcgatcagattgtttagaaggtctacattcaagcggctggtcccccggaccaccttcagcgtttcttctttcaagtcctggtagtcccgctgtttctgctggtattgctccctcaaaagttttgccttggccttcacctgctccgcctcccggtcccgctgtttttcaatcagcgcctggggcggggctttttgaatccgttgaagctggatgtggatgatttgatccaccagattatccagtttggagacgccgtaggtggtctgcccgtcgcatttctccgcggccatagctttgttataacacttgtagcaggaataggtttttttcactaccgttccgtccttcttcttatagttccgtccggcggtagccagtgagagccgtgcgccacaatgcccacagtagacattccccaccagaagggactgccctctggtcgtaagagggacctcgctttgagggactacccgctcacgcacaatctcctgagccctggcgaacacttcctcgtcaatgattttgagttcgggcagtacgctcgactggctttctcccttttggatgattccaatacagatagggtttttaatgacccggttgatgatacccattgtgattgtcttgccgtctttcgtgcggaggccctgatccattaaatagcggtgcagtctcagcgccccgtacccttcatagacgtatttttggaagatgattttcatgacctccgcctctccgggctcaatggcaagatcgcggacctcgtgatttttcttgttgattcggccccgcttcaccgcctgatagccaaacggtacgcgcccgccggtataatacccctcctgggtcaactgttccagccgggtttttacccgcagggaggtcttgatgctctccccggaggcttgccagtaacggatatagttcaggagtttatccacatgggtgtcaaaacgctgctgaccttccatggcgctccagacttcaatgccctgcttgacaaaccactccacgacaaaaggcgtttcatcgtcccggcggcccaggcggtcaaacatgaaaaccagcagaatatcaaactcgcctttcaaggccattttttgaatttcctgtattgcgtctctgtccttggcggagactttgaagccggaaactcctttttcggaaaattctttcacgatctcccagccggattgcccacggcaaaactcccggcaatactgcttctgcatgggaatgtcgtccttttccacctggcctaccgtggatacacggtaaaggcacaccacacgctttttgacagcctgtccgatcaactcagaaatctgctttatgccttgcatgattttttcagccatatatacctctcgctttctgagaatggtgtatatatggcggccggaatattttgttttcaaggtgccatttacaccattattatctcatatttaagcaaaatatgcaaaaaatcagatttttcgagtagttccgctgactaaaagagtttctttaatcaccttgacagcagacgggtttttctgtctgctgtaccgcaccgtaactttgcaaccgtcgataaaaagtacctctacctccgtccagggctgcgcttctttgggaagctgaattttcttttccatagtgcaatcctccatagtttcgcataatatgacaaaaaccgccccctcatgcaggtgcggctcttggtatcgtgataatgagttggaacgggtttcaggaacacactggacggcgctggcacgccttacacgggaatttcaccccctgcgggtctcgcaggttgccctctttgcctgcgacggctcacggcctctttggaccgcttcaacgctcggactgagactggacaatcgtatctccccgatatgcggatcatcgcccccaggcccgccacggcctgtttgtgcgcggatggctgctctccctatacctcccttctcaaagtggggtcatggcctgctcattcccgcacggctttcctctcggacgcatatcggacgtacccagtggacctattcaattatcgaactgtcgccagcccgcacaggcccgccggaaaggcggcgggcctgtgccgattggcgtcggtgtcgaaagtcccctcattttgatgtgcattttaggaagatcatcattttccaacaagctgctttctttgctcattgtgcttgttttttgataaaaagtggagcgaattctgtcaaaatacagtccattcctgtcgataatggccgactgcaatcagcatagcccgcattgggtcaacttccatcgacatagaaagaggggaggccaatgcctcccctcttttcagccacccatttctcgcaaatagctggcaagcatgtcgagaaattcgctgtttgtaggcggggttctcaagtccgttcccgcaatgtgcgctaaaaagctgtgatctgtccggctccaacagaaatggatcagagttctgagattgcgctcaatcgatgccgccgaaactccgaacttctttccggtttctctatagagccgctttgtaatcaactggagctgttcgggattctcctggatgcgctcaatcatgtagacggtgcagcggaagccggccagcttcccggtggcccccaggctgcgcagcaggcgctccgcagtcaaaggcattttgaaggtgtcggcctcccggtcgggcacaaagtagaagattggcatttgataccgtcctttctaggtgaaagcgagggcatctaaacagatagattccatagcttataaccaatcctccacaatatcagccagacttgttggcgtaacagtccctttggaaagcaggtcgatcaggtgaaggattttccgaccgctcgttgtgagaccgggagcgatagcggctactccactccgcctctcaacaattttaacaccgtagatctccaggtcttccgcaagtggacttaccagcagataatactccaagatcagcggccccgcaatctttgcacaaagatagcgttttgcgactaattcttcccgcataaaaagcaccccctgcttgaatttgtctctattataccggacaaaggagcatctgtgcgtgggtgctcatatacaatcatcgacgcggaatgcttgtccgtggacgagcggtgtcgaagccctggattccctcacctttgtcacgatccacgttcgattttgtgatgaaaaagtcccctcaaattgaggggacttttgtaacgctggaaatagatgcaccgggatggcgctgccatcccggtgccctagaccacggatgtaagtttaacgaacccacacggtcgaggtggtgactgtacggctgtcatagtcagaaccgacacgggcaaaaacagttacttcagcatagtaatacttgccagaaggaaggtcatacttgaagtctccggcattattatcattgttggttttgaccaatccatttctggtagagccggaaacggaggttacataatcgccgtcttctgtatagaagacaatagactcaacacccacagaagttgcaattttacttgattttacatcataagagatgatgatttcacctcttccgctcccagtgagcgcttctgcgaagtatcttgaaagtgtcagactggcacgagatgatgtcacatttacggcggaagcatagccataggtggcaaaaagcattactatcgccaaaaatgatgcgcagattcgcttcaagttatacccctccaatagaatcaatgattttcttcatgtactcgtcggatatattgcctgttatctgttccacgatcagaccatctgaccaagtcgcggttatggtatcgacattggataatatataaaaagtctgttgatcgttagaatattgttcgatattctcggtgtctttttcaaactgtgtaccagataaataatcagcagaagtgtatctgataatgtccaggctaaaagtggtgccattttcactggatgcgacaaagttaactatgtcgctcacggatgaagacactacttcaagattcccggcctcaaagccattcgggaaccacgtcggggccagactctcatcgatctccagagaagcaagtgcctcccgcagatcggaatactcaggcgcgttttcacccgcataggcacctgtggcctggttattttcatctgctgacggcacgaaatggaatacctcatcagtccagcgtccaatcgtaccaaacacatcgatccccgccgcttgggccgcgaccatcccgccaaatacggcggccacagcaatcaccgcaacaaggccctgtttgagccaccggtgcaagcggggcctgcgagggtgagaaaactcggctggattctcggagctggcgtcaggctcggtttcacagggatacagagaggcgtcaaccccctccggtatattgtaatactcctggaactcagcccaagccttgtccacatcggggatacggcccgtggggtgctcatcctctctctgttcaatcacctccaggatatgaaaaaccacgtcctcattccctggctctgccatctccatatccatgcgcagcaattcctctagctgctcggtattaagccggttcagataggcgtatttttcatcgttcttagccatgtcgtgaacctccttcacatatatatgaccgtttaaagcgaatcctgacaaactttttcacttctttttccttctcttttttcgctcaggaaatactgtatatagcttttctctgattcgctccaggcgtttctgactggcgtacacagatatgccaaactcctgtgccacctccaggtggctggcacggtcaaacaccagtcgtttcagaagttgatattcctccggcgtaagtaccctttcgaccttctctattaccgactcctcctgcggctcaggctgcgcggccacaagttcctccgggaggttactctcatccgggaaatcggcatccagggagagcagacggaggagatctctccttctagttcgttcgttttctttgagcttattttttagggtgttcatcagccagccgccggggttttcatgctttgcaaacacatcaatacggcgtagtgcttcatggaaggtatcctgaactacgtcctttgcctgctctggatctctgagcacagcattggcgtatataaataattttttgaagtgcaagcggtatagacgctcgaccagctcatttttatcaggcatcatagcagcaatcacttcccatcgtctttagtatatcatattacgatcccgatgggaatttttccttcggctcaaactcctcaatgcagacccggatcattctctcgattcgctccaaatactcatcggactggcccgccagaagctggttgatgtttgccaactgtgccgcggagctttccgtgctcaatagggcatcaacacttacattgaggacctttgctgtggcatagagcgtttctaccttcattttcttctgaccccgctccactcttgagacaaaggcggtgctgatcccgattttttcggccagcgttgcctgtgtcagcccggccgcttcgcggtaccttgcaatatttttgccgatgatttcttccagtattttgtgggccatactaccatcctcctgtttggtaaaattatattgcccaaactcactctagtcgaagcaccattagttccatttctattaactaataaaatttgcgaaattatgtcagaacaaactatttggggtcatatataaatgaaggtatcttttaaggatattttatcttgtctatggggaggggatatgccaaggtttaatactataacctacttatgaggagtgataatcacaatacgtttatatttattgggtctaggcatctatgcttatgtatagagaggactcaaatgtctcttaagtcaccataccaagtgaaagttgtgtttatttgaaaggacgggtaacaagtcatgaaaaagcgaatttttagtgtgctggtttgtttggcagtcctggtatctacaaccatgtttcaagtcggagcgtcgtatcaaccgactgacgcacgccaagctgaaatagacgcccttatcgccaagacagacagtcatgttttagaagctgaatccataaatacctcagaagttcttccctttattcaggcatccgctgtatacgagcaggacgacggcacgcagactccggtagatgtagatcttcaaattcaaaaacttggtacacttactagagctgccggaggtggaacactatatgaagtcaaagcctccactaagaaagaagagggttccgcaggtggtggccgcaaagtacaggcaaacgcaaccctctactggatagataatcttggcccagttaatgagctgtaccgggttaaaggcgagtggatcaactctttgtatgacactgccaatcccgaaagtgctggagtactttacggggagttccccgcaaatgtccctggcgatagttgtgtagctaagcatcctaacgccatgtcttttgattactatgctgatgacattaccggatatactctaggcgtacaaacatcgataaagtgcgaaaagaatggaatcctctaccttattgtaaccagttcaatattctcgtaagttactcaggagaattatagtactatgaaacttgtagctccgattatcaggacaatcatttttgggtgtatcagttggtccgttctatttgcgactaggctattgatgctaccatttgatctgtctccgtatgtttggctactcatacaggctgttgtttcgatagttgcaggagttttggcgggattgttattgcgggggaaactgtattctgcccatcttgaaattaaaagcctattggtgactttactgccatacatagttacttggattgctataacatttttcatttttgcgctatcgatggccagaatatacaattgcttacctatgtcacacctaattatgtctatttccgaatttatgtctcccagtaatccagattcgctctatatacttatctctatctcattattcgatcctacggtacacggtttcttaactatcatgggtgtaacctttcttgccagttgtatacagtggaggacaccaaagcaagtcacaaaaagtaactgagtacatattaggatcatccttgacaaatgttgatgagatgagatgtgttggccattaagtactacatccacaatgcgacctatatatcttttttagaaaatgaagatttgttgttctttcttcatgatttgtagtacaactgttcaagatcaataaatccgttaggtgcatactctggcactaccacgttgttctaaccgctggaacaatggcggagcagtgacttcctaccgtttcgcctctccaccacaatcttctaaaggagtcattttccgccgtattctggacgagcattttgagggcattatcgcccatgccaccttcaacatctctgccggcaggatcgaagggatcaacaacaaaatcaagaccctgcggcgcaagggttatggctatccagacgatgattacttcttcctcaagctcttcgatgtcagccgaaagccttacatcaggaatccttcatcccacaatgtttatgattgacccaaaattttcttggaattatgtcagaacttgttatgcccggtcatatataagtagaagcgcttaaaaagtcaacccttagcataccataatgtttttaggaaagaaggtgtctcccttggtttagtgttatttttgtgagttttccgaatcaacgcatccaaagtctatattttaaaaggagtatcattatgaaaagagctatttctatgatcatggtacttgtattggccctttctatgtgcgtggttggcgcgtccgcagttgaatcagatgcgatatctgaaacttccgcaaccgttggtaatgagcgggcttcgtggggatacgttaaaattcggtatgatccaaacggtgcatggggcgaaggatcaataaacacctatgccggtactgcatattacatgtatgtaaaagtctatgccacatacagtaatggcgatgccgatggccccagcgataccgcttctggctacaataaggaatccgtggtaactgacaagatttatgaaaatggcccctaccgccagtattttgtatcaggaaagataagagatacatcctcttctggatatcagtatggcaacgaggactccccgctgtttaaataatctgtatcggttagtttctagatcagaaatgatgttggtttttgagtaatagaaagcacatatcggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctgccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgacccacatatcatgcacattatttgtgcatgatatgtgctttctaataaacatttgctgaaaggattccggtaagatgagacatagtaagataaatggacttaattctcgctctactaccctccgcgcagcaatagttcctaccgcatttcttttatttgtaggtatagtctttcttgtatatttgttacatatagatagctctaattcccatactaatacatcagaactcattaaagaaacaccatttgaaaatttacatcctgaatttgaaaatagctattatattgatgtatacaatgataattctacagatcaacttaaagaaaagaatactattttcttatctgatgctaacaatccgatatatcttgaatttgccgaagtaggtagcagtactcaagtcattatggtgctctattatgattatgtgccaattaaattttctatagatggcaaaaactacgttgagagttatactttcgatgctacagatagtatgaaagttactatacctgtatttttagatgaagaacagctaaatagagatgatgctctccacaaactttttgttacttttacagtttctccaaatcaccacgccgctgaatatgatagggtaactaacttttatggcgctaatgcagtttatgatctagtttatagcttatcttctatggagcctgtatttgaatccgaaaagcaacacgattattttattcctgacgggaatcatatggatagcttcagtccattaacgctaaacaccgattatggagccaaagaattgattgaaaatgacggaattttgagaccagagcctctaattgaacataaacaaggaactcccttcaagctaatgtattttttagacaagagcgaagcatcaaatacactattgataataactataaatttttctcaagctaaagtcaatgggaaaaattactatgcgctttcgcttgatggtaatgcaggaaccgcttatggagaaatcgaaatcgctctaccaaacgagccaggaatgtacgaaattattggatatgcaatacagaacccattttccccaattacttctgacaaggttcttgtagatagtagctatagattcacactaaatctaacataaacatagaaattgttgcctgtcttgttagcaacagttttgtgcgttatgtgtatcggcgtgcaggtatcataattccccaaagaaatcaattcagtgaaagccagatcgccgcgcgtgaaaatgtaaagctcgaaactcccctcaaattgaggggagtttcggctgtttactggaaaatatccggccgccccagggtggtaaagccgctggcggcaaactccgtcaccaccacattgttttgtccgctggaacaatggcagatcagcagtttcccgtcctccctccggcccaccacgatccccacatgggaatcgtccgggtagaaggccaggtctccgggctgcgcgtccgcctgggaaacaggcgtgcagtaggagcgctgggcggtggcaccgccgccacggcccaggatgtattcgccgcccgtgatgttgtagaaaatccaatccatcatgccggagcaatccaagccgtaggggcggtaggtgccggtggtggaactgcccgcggcggtcacttcccggagcgtcccccaccggctgtcccagccaatgaccagggattttccgccccaaaaatatcccaccttcccaaccagggaaagcgcggtctccaccgcctccttccgggcctggtccaggtcagcgggcaaggcgcggatcacctccaacagatcggcgctggtgatggtgaggctcccggccagggaggccagggccgcctggtcggacagaagttccgtcaaggcgctgttctgttcatccgtgaaagcgtagacggcccgcatttcatcggcggtcttaggggtaatggtgatatgcaggatggattctgtccacccctcactgtcctcgccgcccggatggtctatggtctctactttagatgtgatctccgtcatgtcccaaaatacagctttcaaaaggtccacccggtcctggtccagcgtggccacatccacgcctgtgtccttcccagccgtatggacggcgaacacagccaggacctcggcccagtccggcccctgaccgtggatcacaatatcgtcgtacccccccgcctgcaacgcctccagcttggcgttgtattccacattgaccgcggcaaccgcctgtgagacagagacggtctccggggcgctgggctcgctggtaaagaatatcccaaagggggaactggcgatggcggcaatcagcaccacgacaacgagaacgatcaaaacaacagcgccgcctgccagcccgatcaaactccccatcatagcggccacggcccggaccaccgctgccgtcagcctccggcccagctcggcggctccctttgcggtgcgggccgcctgctgggccaggcggcgctgggcggactgccgggcggcctgggcaggtttttggaacgcttggacaaatcgccgggcaggcttctcggctccccggaccttgggccccagaggcgccttgcctcccggcaagggcgcggcgcgtcccttcgtacctggggctccggtcttgggggttgccccgcccatgacagggcggcgaacatcctcccctggcctccagacacccggaccggaccgccgcccctcgccggggcggccctcaccgcgatatgcggcggacctgggcccgcgggctggctcccgccccgcctttgcggaaggtgcttccgtcggcaaggcatccgggcgcgcctgtccctggagggccttgccccgcccgcgctcttttgccgccatccgggggcgctcccggatggggaccgcctgctgtccgcctgggctccgctccctggggactgtcccttgccgctggggcctctgaccttccaccggcctccgctccttgggggcgcttgtcggctgtccctggggcgggacctcccgttccggccggccgtctctattttcctttgcgctctgcgtattcccggcaccggatttcctcttgtggtttggccggagggcctgtataaattcatccgcgccctgaactccggcctgttccacctggtccacagcataggagccgttttcggcctcccgctctttccgctggtccacttcccggaccagcttctctttcatcagccgtccggcctgtctgggcggaccggcgctttttcgtctgcccttcggcttgcccgccttgggcttttccttgatctccggcatggttcctccttactcgatacattaaaaaagaactcccctcaatttgaggggagttttgacatggcttcacttgtctgtgtgagtggtgttccacagttgatacagggccccggtccggggaaactcgttggcaaacgggacaatagcgccgccgacacggagcaggccgtgaccggcctccgcgttggtgacatagcccatctggttttccgagatattgagcagtttcgccagctccgcccggtctgtggcggcctggttgagaagcaccagaaactcactgttggcgaacatgagccgggccgtctcggagcgcaggcactcctccacattctgcgtggcggcggtcagggccgcgccgtacttgcgaaaccgcttccatgccttgtagaggaattgggcggagtagtaatacttgaaaaacaagtgggctaaactatagacgccttaccgcctcgcggcggcgggttttccatagctcgcccccgaaccgtacttacacctctcgatgtatacggctctctatttatccaccctacgaatttgtgattgttttgtagcagtcctcgcacacaatcagcgtcttgcggcgctttttcaacataaattgttcccagggctcgttgccggaaagacttttcaggttcttcacctggtaaatcataaccgggagttcatttttacagcacagctcacagtatccggtcataaatctggcaatgacttccttgggtcggatggagtatctatagtccggcgttgtgtccatgtctaatttagacggcgcacttttccggaaaccgttatggtagaactcggcccgttttatcccgtgttttgtttcgtattctatgccaaatatgcggtctctcgtatatttcttcttgactttcgctgcggagcaccgcattttccttgcgatagtcttatacatgctgtactccatgacatagcaaaacttgttcaggacagatacattccgtgccagacgataatagttgtagataccccggatttctccgttgaattgtgcgaggatttcaataggttctttgttttgcaagccgttccttgccacaggcatccaaatttctttccccgtgccatccttttgtatattaagcgccctatactcttgcagtttacccatccatttttcctttggaagcaggaggacaacgcgcccattataggctcgctttacgccgccctttgtctttttgaccgcctgattcttgctgatggtgatgtcgtatcccaggaatcttgccttgtcatgtccgtgggtaatcagggttttctcaggcgacatggtgaggttcaattcctgtttcagaaattcactgacggcggtcttgatttgttcggcgtccgctttatttccaatcacgccaattagaaaatcatcggcgtaacggacatatagaactctgcgatagttggggtccattggctcccgactgggggtagatagcaggattgcctgtaatttcttctgcatgactttggcgtctttccgttcttcttcgctcatggtgttccattttttggcgtttcgttctctggttcgcgcatagtggtggttggcattgacatagtcgttgctgaaccgccgcttgtcgcccttgccgaattgcgcccggagcttttccatgaacaggtccagctcgttcatatagatattcgccaagagtggacttaccccggagccctgcggcgtgccactgtaggtctggtgcttcatccagtcctccagatacccggcccggagcagcttccaaatcaggtctatgaaagcctcgtcctttatccttcgtttcagaatgttgaccaggatgtggtggtcgatgttgtcgaaacaccctttgatgtcgccctccacaaaccagctgacgccggtgaaggttttctgtatctgcgacagggcggtatgacagctttttccgggccgaaaaccatgagatgtgctttgaaaggtcggttcatagatgctttctaaaatcatgcgaacggcttcttgtaccagtttgtcgtctgccgccgggatacccagcgggcgcagcccgtttccacttttcttggggatgtactgcctcctggcggggtggggttgataactgcggtcccgcagttttttaatcagggactcaattcgcttcaggctcataccgctgagggtagcgccatctgctccagccgtcgtactccccttgttcgcatataggttctgataggccagaaggtagagctgagggttatacaggttgcggtaaagacgctcatactggtaatgcgctttctgcgcgtgctttcgtagggtttccaatactgtctgtggacttctcatagtgcctcacgcacctttccttttcagtatcaggggataaactgccacccttcgccatgtggacgccattaacgccctcggactactatggtggctccgtgaccgtgccggatattcaggcccaggccatagctgtttccagcgttccggtttaggtcatctccggttagaactatgcaaattggcctgttctgctgtcggatgcgacttccgtcatttcccgctgactgcgggcggctgatatggatgtgtacgcatttggcgatttaccttcaccacttgcccatatcacacggcgcatatagtcatcttttcgccgtggcggacgataacgctcctctgactatcgttcaggcagtttggctttcatcctcatgcagaacttttcatcttggcactcagtcgcagcgtgatgactggctgacttatgccttttccggcgtgctgtgttccccttgggatttctcttgcgggtaagccggatgatgacagggtttcagatttcacattttcccttccacttgccaaaggtggaatttgcatagtcccgcgctgcctgcgttgcttcaggcggcttccggacgcacgtacacctcatccacgaatacccaggtgtatttcccggccaggcggttggtggctacccggttttgaatggtctccatggtgacgttgagggcggtgggcttcaactggtcccccatctcgtagaggtcaaaaacaatgatccggctgtctatgtccacgttggtctcatgggcaaacatatttaaggagccctccacgaacagctcggaggccagggccagctcctgggcctcccgttccggctggcgcttgatctcgttcctccagtcggagaggatgggctggcgggccttgccgccgctcttgatgaagtcgtggtacacgctggcggtgcagcggtcaatgatggatttatggaaagcccccaactggccctctcccatctgctgttcgcaaatgctcatcagcagttcggacttgagggccaccgggttttcccccatgccgtagcctctggcgatttccagaggattgatgtggtggcggctgtttggggagatctccaggacgatcccccggagggcccgcaccaggtccccatactcgcgctcggcgtcgatgatgataatatcatcattggtagacagggcgataaaggtgataaactccttcatggtgaaggacttgccggagccggagacgcccaggatgaagccgtggggattgaggagattcttgcggttgcagatcagaagatttttgctgacggcgttgacgccgcagtaaatgccccccatgtcctgaatctcctggacgcggaagggcatcagggaggccgcggcctcggtggtcagcgtgcgggtcacgtcgatggagcgcaggccatagggcagggcggtgttaaagccgtcctcctgctggtatctgagaatggagaagtcacacagggacttggagagcagggtctccgtgtcggcgtcgagctgttccagtgtgtcggccatgtgcagcagggtcacattggcatagaccatgcgctgatccctggtgctcagatcgtccagaaattccttggtctccgccctctgctgttccaactcataggggaccacggcggtaaagttgttccgggcgttctgcctctgctgccacctggtaatatcgctctcaatacccatgatctgagactgcacatcccgcaccgcttcgtcggtggggaccgggagcaggtcgatggacagcaccagcgtccgggggaagtcggccatactggtaatcatgtcgtccttgatgtaactggaatacttccgcatgaacagcacccgccccactttgccgcccagttcaaagtggtcggagagaaacttcatgccgtcaggggcgatgtagtctttgaagctgtgccccaggcgcatggaggcgttcaggtcaaacttgtaaaactgttcctcgccgggccggaagaagtcgtggaggatgcgtaggcgctcataggtgtccaaggctttcgcgccgctgtccagacgccccaggtttttcgagaggtcggcgtctacccggtggaaaaatgccctggcctcctccgcgttcttacgggccacggagacggtgatgtacttgtcctggatgaggttgttgctggccgccgccttttccgtgagcacccggttgtattcccggcggtacaggtccaggtcatccccgcactcgcgcatgaggacgctgtgctgaaagtcggagctgttgaggcggcggttgtgaatggtgatcttggtcacggcgtcggtgggcaggctgttgaggacgccgcagtaggatgtgaacatatcccgctggtcctcgtaggaggccagggagtagttgatgtccgcaaagcgccaggtctggctgaatctgccgttgacctgccagatcccatcctgccaaacccgctggatggggatggactgctgtacgctgcgggggatcttaaacgggacacgctcgccccggttggccgcggcaagagttttacgcatggcggcgcgccccctttctgactggggccgcataggccgggaaaagggagagaaattgctttttcatagggacctccttcaaaatggacggaaagaggccatgacggtccggcacccaaatctgccgcgcatcacacccctttccgctgaaatcaatcgccgctgctgcggactgaattggaacacgatggggggagccgccaaaagtcccctcaaattgaggggactttcagccgttcccggcgctcagggtttctttcctgctccccatatctttctctgctccggcatggcctggaggtagatattctccgcccggtacacacggggcccggcgcacaggacctgggacttgagaaacgcccagacaaaccgctcaaaggtcaggccgttgtagcggaaaaagccggtcacagcgatgggggcggctgccaggatgcacagccaactggcggcctcctggcccacaacgcctttgaacatgaggtaaaccccaaccgccgcgcctacggccagggcggaacagagaaattgccgcgtggacaggccgaaaaagatcgtctcccggtgctggtggacttcctttggaattttgatctccatattgctatcacctcgaaaatggatttttttgacacgttttttgaaatatgagataatatttgtaggaaaaaccatacatttcaaaacaaatagaggaggatttttatgtttcggaatctgacgctggcacagcaaatgttctttttcgtcctggccgtgttcctgatcctgctggtattccgcatcctagtaaagctgaaactggctcctgtactgctctacgccgcctgcgcgaacctgatcttccctgaatgggtggcagagcagaaggcgctgtactgggccatcctggccggtctggtgctggtgacgatcttccgctgggtcggccccaggctgaccgcgcacatggaggagcagcggatcatgcgggagatcgtggagcagagccgggcggcggaggccatggggtatcggaatgaccagattagttttgaggtcaaggaaggcactccgcaaatcaaaatcaggcagtaaagcaacagggggatgggctgcaagctcgtccccctgttgctttgccgaaagtcccctcaaattgaggggactttttataggccgaacaattctcgcacaatacgctcggcaccctttaccaggccaaccaacaccagcatattgaaaatagtctccgcgatgtactgccaggccatgaccacgggggtcaagttggtgtccagaaccggggaaccgctggacatgaaggcggaaaaaatgaggcaggccaggacgatcacggccccctccatgcacacgccgatataggacttgatgaactgcttccccgcgaaactggtcccttctccggcgaaggtcgccagagggatcggggccagggcagtaaaaatgtagaggcggaaaaagcggccatagaccgtcataatgaggatgaaggacatcaccgtgataaacaggttgcccagcatggctaccagccagagggggatgctggctaaaaagccgacgttttcaatggcgtccaccatctcctggggcaccgtcacaccggcggcaaccatgccgcccattccgctcatcacagactggacaatgccgccgcagatggaaaaaaccacggtcatgatctccatggcggagctcaccgccaccttggcggcaataaagcggatgaaatggcgcagggcgtattccggcctttgcaagtcccggaaactggctgcggactggaagattcccatggcgaaaaacagcaccagaaggccgtagcccacggccttcagcccctcattgatgccgacaatggcgttccatatatcgccgccccggaactcctggggcgtggtggtaatcagggaccatatctcggtcaacttgtcgttccaaatctcaaaggcggattgcagagcctgcaccacccagttatcgctcacagcccccacctcgtttctttcttggagggggcggctgattgaaaatcagccccgcctccttgtcaaagtcagtcgcccgtaccttatggaccgcctcacgccgggaacagccgaagtaggaccgcacatggatttgctcgtttggtgtctgtacggtcatcttccatgctccaaagggtgtcctggtacaggagagaattttgttgtacttccgcatggcaggtcacaccacgccgatagcggacaaaatctccttggaaaaagcgatgagcaaaccaccgaatacgcagaggatgccctgggtgcgctgggaggcgtcgtgagactggatggacatacccagttggacgatgccccagcccagcacgatcacgccgacggccttaatgcacgaaaaaatgaagtcgctgaggttgttgacaatggtaaggggatcggtgtcggcggccagggccgggcaggccagggcggcgcacagggtcagcatgaggacggcggagaaatagaggcggtggccccttccggtccgccactgagaaagggtattcggctgggggtgtttcttgttcaacatgaaaatcaacctttcttattccagaatttcgatgtagtccaaactctcaaaaggcacggacaggtcggcctgggcgtaagtcagtccggggtggtgaacgtagggcgctgccccgccgtcctccgtcagtttgatataggggtgcttgagaatgtcatacttcttgtccatcacagggcgttccccccggatgaacagcagggcgtagtcgttgtccagggtccgcacctcgtcgggagtcatcaactcccgacccgtctgctggtagctgacggaactggagccgtgggagccgcgggacacgctgcggttgcgggtgtccagggtctccttgcccagcagctcggagatatacttgtgggtggacggctcatttccgcccagatacaccagcgtgtcggcgttgcccaaaagcccttcccagtcatccttgaacagggccttgagggcggaaatgttttggagtacaatggtggacatgatgttgcgggagcgcatggtggcctggagcttgccaaagtcatccggcagggagacgttgcagaactcgtccatcatcaggcggaccgggacgggcagggccccctggtgtaccttgtcggcctggtagtagagggcctgaaaggcgcaggtgtagagcatccccaccaggtaattaaaggtgccgtcgttgtctgggatgatggcgaacacggcctgcttgcgctcccccatgaggcccagctccatatcgtcccgcgaagtgatgcgggtgatctgaggcaggatgaaagcggaaagccggacagcggcgctcaataaaatgctcttggctgtttttcctgccgccagcttatatttcttatactggcgcaccgcaaagtggtttggcttttctgcttccaatgcgtcaaacatcagatccacggggtttttgaactcctcgtcatcctcccggacttccatggcgttgatgaactcaataagggtggaaaaattctgttcctccaccggagcctcatagtggatatagccaatgagcgcacaatagagaagcgtttctgccttgacccagaaatcgtctccggccttgccttcgcctttggtgttggcgatcagcgttgtgaccagcttcaagatgtccttttcgctatggatataggcgaaagggttatagtgcatggatttcttgaagttgatggtattgaggaccttgattcggtacggctcataaatgaccttgccgtgcttatccttcattggctttccgtctttccccagcttgggtgcgcccctttggagcatttttccgcactccaccaaaatggttcccttcgggtctgtgaccacataggaactgtgcatctgcatcagattcggtttgagccagaagcgggtcttaccggaaccggagccgccaatcaccagcacatttttgtttctggcggtctttgggtccttggggcggctgttcattgtcaggctctccgttttcgtcagaatcacattgttctggaataccgggtcgatgtagggtgtaatgtcctcatgggttccccaccgggcggaaccgtattccatgccgtgcctgtacttcttggcgttcttgcttttcaggtacacagccagccgcaggccgccgcagcagcacaggcccaccagcaggtccagcgggtgcaggctgggccaccagctggccagcgccaccggcagcgtggagaagaacgagagcatttttgccgaagcgtccgcacccacggccatccgccacgcttcaccgaagttggtggagaaaagccccatcaggatatacggcagattcagcaaaatgagctttttgatgttcagctgctttttcatcgttccagctccttccgcttgttccggtccacgacggcgtgttttaccagttctttgaactggctcagctttgccagcacggacgggcgctcggatttctccgcctttctgacctttttcccggtgtactcggtaaaagcagcggtcagggcatccgcgtcccgacccttgaaaaagatcaggtacttgggtggggagctgctgcggtccttcttcaccgcatagtccacgccgtatttccgggcgatcttctcaaactccttgatggaggggtcggtgatctcgatgttggaaaccccttggttttgaccaatcagctgtttcaccgtctgcttgccctggggcttcacaggcgcgtcacggcttctctgcttttgcagcttcttttccttgcggtgggcaaggtacttgctgatggcggctttgagcagcctgccggtgaactttgttccgctgacaaccagcgttaaagtcctgttttccacttcttcctgcattttcatcgcctcctttccacaaaatgtgcaggggtggtgcatttatttctaaggcgggaccaccagccgccggagaaggtatttcttcatcgaaccgccctcaacgaatttgctcagaacggtcatagagcaaatctccatttctgacctttgcatgactgagaatcttgatctgtccctttgcctgactgtccagagctttttcatagcccttatctgacaaaaacaggcgggttcgttcacctttccagcccaccggggagtcatgcgtcagcacatcaaaaataatcatgtgccgggtgttctcagcaaatcgctggagatccatgtagtcatggccgtgatagttctgcgctccagctttctggcgcatttcttccatcagctgaccgattgttttgccttctggcataaaactcacttcctttcccactctcatacaaccatcaaaatcatgtctctcagctgagcaaagtagagtttgccttgcggggttatcagcgtataggagccgatatgcccgtgattgcagtagtctttgacacaaaacagtccttcattggctggctttgcatagggcagtacattaccggatgcggtgcggtacacaaaacgcttttccagaaggaaacggacaaaccgacgctccgggacaagcaactctttggcggtggtgcggaggttggtactgtgattgaggtcgatgaacaaatcataaaaggctgccttactctccagcagggcattttcctctcgtagcgacgcattttcttcccgctcagcaagcagctcggagcagagctttatcagagcttccggagaagtggctatctcccacaacttctcttttgtgagataggctccgtgcttgcgaatggcaggtagaacttcatcaaacacccattgttcaaaccgttccgctgacggcagtttactatgggcgatcagacgatatagatcaccttcggggataaagagcatttcgaccatttgtaccgcggggcttccatctgcctttttcccagtctggacccctatggaacatttcgttccacccctggtatggtcgcggacggctttgcgtggattggtatatcccagcgctgttgccacatctgtaccgcaaaataatactttgccattctgttccaaagtgcgaatgcttccgaactctggactattgaaaatttcaatctgattcatgctgtgcctcctttggtgtaatacaaaagcggctgattaccagccgcctgcgtgcatatcgtgatttaccagtgaagtgtagtggttattcatggtggtaggagcgttgaacagcactgcaagcaggtactgcttgatgttgtgtacctgggtggtgttcttttgcagacagtccatgacaaactcgatgtgagagctgtccagcttcaaaaagcgggagcgtacaatttcatgaggaaagtccgcaccagagatccgggtggtctttcgtttggcacagaccgtttctaccaacagctctacgatctcatttaggtcatccaggtagagaggataacgctgcttcagacaatcatactcgatattctccaaaatcaattcccgataattttctatctctgtgacagacatcgcatcccttcctttccgttccggcggtattaccgccgctgtttcccggaagggaatggaatcggtatttgatccatgagtattttgtttttgggtatttgatttcttagtatttaattgtgttggattttccggtaacggatttaccgctgacgggtttaccgttatcgggttttccgacaacggcttatccaacatcggttctccctcgatgggacgctcaaaaatggtatactcattggctgcgaatttaccagaagcatcagttgtctgtctgcgccgaatgtatccggctgtttcaagctcattgacagcagagcggattgcatctttgctttctcgattgatatagctgagtcctgacagcgtataatcccagtcatcaggcagagataacatttgcgacaagagaccctttgccttcaaagaaagtcgtttgtcttttagatgaaaattgctcataaccgtgtaatcgccagtgcgttctacacgaaaaacagccatttacttcactcctttcatttctcaggtatgaaaaaagccgcaattcataaaagaattgtggcagcggttagggtctgtctgtatcttttttcttgcgtcggtaggggcgttttggcattggtggtttatcaaacagatccctttcctgagaaaatggtaaggtttgaaaaacacggtcaatctcggtggattccatatcacgctgtgagcggcaatcttcttgaatagcttctcggatttctcttacagtacacatattcattcctttcctttcgttgtatcggttatgaacgacggtgttttttaggcttgaagtcgaggatatgcccctcaataacatgggcatatctcttaattttgatttctcgacgctgctggctttgcggagctgactgatacccgtcctctgtgagaaaaagcctcatttcgtcaccaggttctccataagcagtagggcgcaagacagtaaactcaatcatccagaaagtgctgtcccaaaatcgctccactgcaagaatgttgtggcctttcagttcccttgctgcaatatctttcataggctctcccttcatcgttcctgatctcgttggcgttttttctgccattgttccagcagtttaataatggtttcctgcattttggccggtgtatagcttttggggaaatactttcgcaaggtatcgctgctcaaggtcactttatccagatcaccctttttttcctctgacatgatggcaagcatcacatcttctgacaatttcccttcctggctgaactttttcattcgctgagcctgagagagagaaggggtagcctgctcatagtccattgtttccaccagcatttgctgttcgtccggtttcaaaaaagagagttcataggctgggttaaatgcgattttcttttcatccaccatatccaaaagctctggaatcagttcagtcaaacgaacatatcgcattacctggataccgcttcgttcaccggcttcttttgccacctggtctctggcgctcaacttctgttcaacttgaacagaagtcaggtctgttcttgctccttgatgtttaatggcttccagcttcattttgtaggcaaaagccctttcactggggagcagattttctcgctgcaaattgctgtcaaccataataattgtggcagcatcgtcatccaagtcgcgcacaatgacaggcatggtttcttttccggccaattcgctggctctgcggcgtctgtgaccggctaccagctcataaccgccatcaggcagtggtctggcaatcgcaggaaccaacacaccatactttttgatgctgtctgcggtttctatcattgcatcatcatccttgaccttgaaggggtgatccttgaacggatgcagttcagataggggaatttcctgaattttttccagttgctcgtcttgccgactttcttctgtagaaaacaggtcatctactgaggccagctctatttttttcgcgctgcttttcaagtttcaatacctccttcgtcagatttttgtagccctcagccactttgccattaggatcatgggcataaatgctttttccttcagcactgatttctttagccctgacagaatgaggaatttctgatgtaaacaccttgatcttactgccataggtttcgcgcagaagagcggagatttctttggcaaagttggttcggctgtctaccatcgtcagcagaatcccatcaatttgcagcttaggattgatttgtctgcgaaccttattgatagtttgcaaaagttgctccaaacctttagctggaagatactctgcctggacggggattataaccctattagcggcagccagtgcattgaccgtaagcatacccagggagggctggcaatcaataaggatatgggagtattgccccttcagcgtgtccagatattgtcgcagaatggtttctcggctcatagcgtttaccagagatacctccataccagatagctggatgtccgcaggcatcaggtctacgccctcagggtggtgcaggataccctcgccgggacgaattggttcatccatcaaaatacggcccatagcgtctgacagtgtaaagggcagcttatcaggctgaggattgcccaagctgatggtcaggcttccctgtgggtctccgtcaatcagaaggactttcttcccggactgcgccagaccaattccaagattggcacaagtggttgttttgccgacaccacctttttggttggctatggcaataatctgtgtattcataatttcacctcatttctttctaagtttagatatgaaaaaaagtgcctgctctacctttcctgaaaaagataaaacaggcacttttactggctctatacctcttgtaatgaacctctatgtatggtaaactatgtccacgataccatgaatataattaagtctcgacgggaattgaacttttggctaacgccaaatttcgcgcctttgcaaacagagtgcaaacaatagggggctaaaatcctttgtttttgcttgattttgcttgtacaaggtttatagagaacatggagaaaagccttgatataactgcattttctttatccccgttgatagggaatatatgcactggggccatctcctaagcgtggggtcggaggttcaaatcctcttatggacgccagtgaacaacgccgaaagcctttgttttcaagggttttcggcttttcttatataaaaagctacgaaaaagctctttcactgtatgagataaaattctactccaaaatttgatttttgacaacccctccagaatcgaacggttgttataagacaaaatcgccagctaatttttagcagaaaacgggctgttcttgctaatgaaaatgcccttcctgctaatcagccccaaaatcgtgccaaaaatccagctaatcaaaaaaggcggatgttttgaataccatgcagttatagcagataaaattaaatatcgttatgtacatagagcgtctatttgccccgcattggggatggataggcgctctttttttatgcccaaacccatgggcaaatacaagagattggaggtgttttatttgagcaagcctgtttataccgcagacaagccgagcgactgtcattactgctacttctggacgaatggcagaaagggctgccgtctgggtagaaataattgctactacttaatctctttgccgccgaaacccaagtcggaatgtgatggctgtccctatgggcgagatcacccgtgcattggttggtgtacgaagaaggttatgcgtgaagtggggcttcgttgatatggatgtgtatgaacaggaataccgcttctactattttgcccgatgtccttacgaaaagacggatacgactttccgcagcattccgctgacaacagaaagttttccgcagaaagaaggtggtgaagccgtgtgagttttgattatttttacggtcagcaatccgatctattcacattctatcgagttccgaaggtgttgttcacgaacgagaggttctggaatatttctgccgatgccaagatgctgtatggcattttgcttgaccgcatgagcctgtctgccaagaatggttggatagataaaaacggtagagtgtatatcatttttacaatcgacgaagcgaagatggctctgaactgtgctgaacaaaaggctatcaagctgctcagtgaacttgagaagaaagcaggattgattgaacgtaagcgccagggtttgggaaagcccaacctgatctatgtgaagaactttatctctgctgtggattcacaactcttgaattgtgaaaatcacaattctggaacaatggaaatcacaactcaagaacttccgaaatcacaatgtaataatactgatattaaaaatactgaatttagtgatactgattctatctttccttccggaaatggtggaatgatggacgagaatgaccggtatcaagaatactttgattatttctcggatcagcttagtatggatttgttgaagaaggattacccttacgattccgaaatgctggataacattctggagttgatcgttgaaacagtttgcacgaagcgaccgttgattcgcattggtgcagaggagcgtccggcagaaattgtccgcagtcggtttatgaaactgaatgccgaacacattcgatatgttatggactgcttcaaggagaacaccacaaagattagaaatatccgtcagtatatgctgactacgatatacaatgcgccgacgacaatagacacctactacgatgctcttgttcggcacgatatgtcacacggatatttggaaggaggatttaagaaattgaaaatgaagcgagaggaaggagagtgacgataaatgtcgaaaaaagcaaccatcattgcggtggtcaatcagaaaggaggcactggaaagaccaccaccaccgagaatctgggcgttggcttggctcttgaaggaaaaaaggtgcttctggtagacaccgatccccaggcttccctgacggtcagtttgggcaatccctgcccggatgatctgtctccgacactttccgatctgatgggaaagattatgatggaaaaccctattactcccgatgaagggattcttcatcatccggagggcgttgatttggtgccgtccaacatcgaactctcaggtatggaggtagcactggtcaatgccatgagccgggaaaccattctccggcaatacctggatacagtcaaacagaattatgattacattcttcttgactgtatgccgtctttgggtatgctgaccgtcaatgcgttggcagctgccgacaatgtgctgataccggttcaggcagcataccttcctgcaaagggtctggaacagctgcttggaaccatcaacaaggtcaagaggcaaatcaacccgaaactgaggattgaagggattcttctgacgatggtggacagccgcaccaactactccaaagacatcagcaatctgattcgggagagctacggcggaaagctgaaggtttacaagaccgacattccccgctctgtccgtgcagaggaaatcagcgcagagggaaccagtatcttcaagcatgatcccaaaggcaaagttgccgaagcctataaaattctgacgaaggaggtgttaaacaatgcagaaaaaaggcgcaaacatcagcttgaaggggtacgatgatattttctccaccgatcaatccagagctgaagcccagcaggagcgtgtgcaggaaattccgctttctgagctacacccctttgagggacaccccttccgtgtggttgatgatgaagaaatgatgaaaacggcagagagcgtccgagatttcggagttctcactcctgcgattgtccgtcctgaccccgacggtggttatgaaatcgtttctggtcacaggcggcaccgggcatcggagcttgcgggtaaggaaaccatgcctgcgattgttcgtgacctggacgatgatgcagccattattttgatggttgatgcgaatttgcagagggagagtatcctgccgagtgaaagagcatttgcttataagatgaagctggatgcgattaaacatcaaggtcaacgcaccgatttaacttcatcccaagttgggatgaagttgcaggcaatggatatagtcggtcaggaggcaggagaaagcagaaatcaggtacaccgttatatccgtctgaccgaactgattccggaactgctggatatggtagatacgggtcagatcaaattcaatcctgcggtggagctttcctatctggcaagtgaagaacagaaggattttctttctgcaatggattatgctcaagcagctccttccctttcgcaagcacagcgaattaaaaagctcgcacaggagggcgagtgtacgctggatgcgatgtgcgagattatgaatgaaatcaagaagggagagctggacagagtaaccttcaaaacggattcgttgcgaaaatacttcccgaagtcctataccaacaagcagatggaggataaaatcattcagcttttggagcaatggcagaaaaaaagagaaaaatcaatggaaaggtaaggtaaaaaatgtttacacccaaaaacattcagggcgctttggaagaactctacgacctttgcgatcctgattatatggtagatatgctcgtaaactacagtgaggagttcgatgatatttctcctgcgcttctggcaaagtcgtttcagaaaaatgccgagatgattagcgagtatcgagtattgtcctctgctggtgagggtatcgactatcagggaaaggtacttctgaacagcagagccgtgcggcttctgtcctatgtagaagatatgagcggcgatgaaaaagttcgcacgattcagagcaaggagctgtggttagcagaagatatgacattctatgtggtgtcctgtatgtctacgatcacgatggacaaggaagaagccatttgtcttaacgaacaccgcagcgtggttactacggtggaatgcgaggacgatattttcttcgacatgggttccctgatttgcgaactggacgatatttgcttgttcgagcttttagccgatgtggatgcgactatttatgaactgtaacaggttcatggatggtcgcttttcttatttccaaagaaacggaggtatcgaaacttgaaagaatacgatgtgaagatcaccgaaaccttggagaaaacggttacggtgcaagcagaatctcacgatgcggcagaggaacaggttagagccgcttattacaattcggagtacattctggactccgaaaactttaccggtgttgcgttcggcacgaccgaggaacgggaggttcagaaagaacaggcagataccatgaatgtgttgctggtaaagccgttcatgtatccgcaggctgtgcagatcggctgtgagctggaggatttgcagaaagccgtaggtggcgatattgaggcaacttatccgttcaatgagccggttgcactggtgatgcacgacgaaggtaaactcgtaggcaaagaactgaaccgtgcgctgcgtgatgatgacggcgatatttatgacattatcgccggtgattttctggttgtgggattgggcgaggatgatttttgttctctgtccccggaactgatgaagcagtttgaggaacactttcatcagcctgagacttttgtacgcatggggcgcagcattatggcgcttcccctgccggatgacatggtgaagaaagaagatgcacctgtcaaagctgattcggttccccacaaaagtaaccctgaccgagatgttctgtaaggaggttcttatgcaaagaaattcgacgattggagagctgatggagcgaaagcggattcaggatggtgccaaggagtaccagggacatacctatatggacttggcacgatttgatgacgccaccaagcacatgattattttcgatgtgctgaccgatgaatcgcctgtcggttggaaaggcgaaagaaatcgcctgtatttgagcgatgtgggttatcagaaggctctggataaccagaaagctggcaatatcaagattatcagccatgccgcagttgccaagggcaatctgtattacgaccacagagatatggcacgataatctgttcactctactgcttgcaggaggtgatgaatcatgcaggaagaagttgaaaacagaacagtaaacctggcgatcagcacaaccaagctgacggggcgcactatcattgccggtatccgcaagtatttgcagcaccgggaaaaagtgaagatgaaaaaggcacgagaccctgccgttcatggaaagcaatccgtgaaacagcttttgggacagaatcagggtgctacgaatgttgagatcgacaaagagagtatccgtgattttgaaaagctcgccaagaagtatggcgtggactttgccgtaagaaaagataagtccgttgatcctccccggtttcttgtttttgtccgttctaaagatgcagatgctttggatgcaatctgcaaggaacatcaggcaagggcattaaccaagaatgaaaagccgagcgttctggcgcagctgaagaagttcaaggaaattgtcgcagcgattccgaagaaggttcgagagaagaaacaggagcgtgatctgtgatggataagagaaaaatgaaaaagctcctgattctgaatttaccgtattttctggtagggttgttcgctacgaatttaggagaagcatggagattggctgagggggcagattcatctgcgaaaatcctcagcttttttcatgcccttccgatagccctgaacaatccgtttcccagctttcacccgttggatttgctgattggtattctctgcggcgcaggacttcggctggctgtctatctaaaaggcaaaaacgcaaagaagtaccgacacaatgttgagtacggttctgctcgttggggaacggcaaaagatattgagccgtttattgcaccaaagttcgaggacaatgtgatcctgacgaaaacggagcggctgatgatgagcaatcgcccgaagaatcctgccaatgcccgaaataagaatgttctgattatcggcggttcgggttccggtaaaactcgcttttggttgaagccaaaccttctccagatgcacagttcctatgtggtcactgacccgaaaggcagcatcgtgattgagtgcggcaacgcccttttgaagcatggctacaccatcaagattttcaacaccatcaactttcagaagtcgatgcactataacccatttgcctatatccattcagaaaaagacattctgaaactggtgacaacgctgattgccaacacaaagggtgatggaaaagccggtgatgagttctggacgaaggcggaaacgctgctctactgtgccttgatcggatatatccactatgaagctccggttgaggaacagaatttctccaccctgattgagttcctgaacgcaatggaggtgcgggaagatgatgaggagttccagaacccggtggatctgatgtttgaagccctggaaaagaaaaagccgaatcactttgcagtccgtcagtataaaaaatacaagctggctgccggtgttgtatgctttagaagacttcttaatcagtcgattgggaagtctcctaaaacatataaccttaaaatcacgaaaggagcgcaagctatgagaagaaacgagaaaatcactgctctctacgagcgtttgagccgtgacgatgaccagcaaggcgatagtaactccatcgttaatcaaaagaaactgttagaggactatgccgcccagcataattttccgaacccgacccatttcacggacgatggtatcagcggaacttgttttgaccgtcccggatttttggctatgatgaaagaggtcgaagccgggaatgtggaatacctctgtatcaaggacatgagccgtctggggcgtgactatctgaaagtcggtcagattatggaaatcctgcgtcagcgtggcgtgcgtcttatcgccatcaatgacggcgtggatagtgccagaggggacgatgattttacccctttccgtaacatcatgaacgagtattacgcacgagacaccagccgtaaaattcgttccactttccaatccaaaggcaagacaggcaagcacctcacaggcttagtcatttacggctacctctggaacgagaagcgagaccaatggttagttgaccccgaagccgcagaagtggtgaagcgtatctttgcaatgacgattgacggctacggtccgtatcagatcgccaacaaactgaaagaggaaaaagtcctcattccgtccgcttaccttgcacagcatggcgagggcgtgaacaagaacaagactttcaaagatatgtacggctggggttcctccaccatcgtaaatattctggaaaagcgggagtatctgggacacaccatcaatttcaagacccgcaagcacttcaaagacaagaaaagccattatgtcccggaggacgaatggacaattttcgagaatactcatgaagccatcattgaccagcagacctttgaccttgtgcagaaaatccgcagcaaggtcagacgctacccggacggctggggcgaggttgcacccctcacaggtttgctttattgtgccgattgcggcggcaagatgtatgtccaccgcaccaacaacggcaaacgcatttctcaatatacctgttcacagtacaccaaagtcccagtcggaacgctctgcaagacacagcaccgtatcaatgaagatgtggtactgtcccttgtctccgatatgctcaaagccattgccgagtatgccaagcatgaccgagccgagtttgtccgagtggtacaggaagcgcagtcaagtcagcagacggcagaggtcaggaaacagcggacacgccttgccaccgcaaagcagagagtttccgagctggaagtcctgctctgcaaaatctatgaggacaacattttaggcaagctgtctgacagcagatacgccactctggacgctcaatacgaaaaggagcagaccgagcttaccgctgaaatctctgctctggaaaaggctatcaggagctatgaaaagcacgaaaaggacgctgaccgttttatcgctctgatcgacaaatatgagaacttcgacaagctgaccattgccatgctcaacgagtttatcgagaaaattcttgtgcatgagcgtgaccgcaaaggcagtatacagaccacacaggaggtcgagatttacttcaattttgtcgggcgatttgttcccccggcgtttggcgaagcggagctgaccccggaagaattagaggaaatccgcaagcgtgaggaacgcaaggacaggcttcatcagaactacttgaagcggaaagccagcggagcgcagaagcgatacgaggacaaaatcaaggagcggaaaaaggcagaaatcgaagccaagaaagccgctatccgtgcggaggacattgcaaagggcgtgttcgttcccgtttgcaatctccccgcgcgagagccgaagaaaggagtacagaccgtatgagaagaatcatcgacaacagccgcaacccccgaaaagaagcgaccccatatcgggcattacgggcatctgtgcaaagtctaccttgagggctaccgccccgacctctacgccgcacttatcgccagcgaacagctctatgagcattgcgcggaaatcgagcaagccgccagaagccgccttgacctcatcattccgcacttgccaaaagcgcaggcgcgacggaagcactcaaagcccaagaccctatgaaatgggtgggcttgatgaactcctgcaaggcgcaggcggaggaaatcgtgaagtttgagctgatttatgattgacggtcaagagccggagaaaacgcatatctggcgctgggaacgcttcggacgaggaatgtgtcgccggagcgttttctatcgaaaaagagtcgtttttctgaagtcaagagacagagaaaacatctgaaaagtgcaaatgcttcaagtagtaccgtaaaaaaatttacaatgatagggttgaacggcacgaagtgaactgatataataatcatgagtaagtttgccctgctcataaatcagaggaaggagaggtgcaacgatgaatcctgtattgaaataccgcggcgggaagtcccgtgaaattccgcgttttttacagtatatacccgatgacttcaatcgctatattgagccgtttttcggcggtggtgcagtctacttttatcttgaacctgaaaatgcaattattaacgatgtcaatactcgtttaatgacattctaccgtcagttgcgtgacgattacccagagatgagagcgcaacttgatgagctgcaacggcagtatgaagaaaaccaagcaaaatataaacgaatgaaagcccaaagtccagaggaacgcgttcccaatgacaacgaggctttatactatcgaattagagagcttttcaatcatcctgatgatagttaccttgatggggtgctatacttcttcatcaacaaaacagcatactctggtatgattagatacaacaatagtggcgagtacaatgtgccatttggtcgctacccaaatttgaacacccgattggttacaccgcagcatagtgagttactgcgtggtgctgagttatacaatgttgattatagtcagatatttgcaatggcacaagaggatgattttattttcttagatcctccctatgattgtgttttcaacgattatggcaacattgacatgatgaacgggtttgacgaaacgcaacatcggcgattggcaaatgatttccgcaatcttccttgccgatcactgatggtgatcgggaaaaccccactcacagaggaactctatggggaatacatcttcgatgagtattacaaaaattacgccgtaaacatcaaaaaccgttttaacaatgacaaaatgcacattgttgtaaaaaattattaggagcgcaaaatgggagtaatcaaaagcagtcgtacattgttttttactacctcgcccaggtcacccaaaaagctaattcccgaaattgctttgttggtggataatttctctggacaaacatggagcggcaacgagcaggtacaagaagaatttgctcgtgcgcttgctactgcaactacatttgaaggagatacctctaagaagtactctgcctttagcgcacgagatcgtattactcgctctccgcaaggcttgggctttgttgatttatctccaacaattcagttgactgatgcggggagtgcatttcttcatggtaacagaccgcatgaaatctttttacggcaactcttgaagttccagttgccttctccgtatcacaaagaaggaagaaaaatcaggggaacattctggggacgtccctacttagaaatcattcgcttaatccgtgatttagaccatctgacaccagatgaattcagaatctttgcgttgcaactgacagactatcgaaactacgagacagtcaagcagcaaattattgctttccgcgaagaaaaggaacgtcataaagggcaatataaaaggtttgttgatgatgtaataaaccgagaaatatccaaaatttatgctgccgagattgaatctggtgacatatcaaccagagaatcaaagaccagcgatgtgaaatcgttcatcaaaaaagaaaaaagcaacatgcgggactatgcggatgcgtgcttccgttattttcgtttcactgaaatgttcgtctccgatggtaggtcaatccagattgctccagataagattccggaaattgattatattctggaaactgttccgagagaacctacacatattgatgatgtaaccgcattcaaaagttatttgttcgattctgcacagcctcgtttgtatacagatgatcgcagcaatttggaagacacgttgatgcgttatttttcttatagcaaaagggaactggttggaaagacaatcgaagaactgaaagatttacgtgacagtgcggttcaagcaaaacgtgcagcaattatccagaaacaaacagaggaactaaagtcgtatgcactgtatcaggaagtcattgatacatacaatgaaatcctgtctgatgatgtatacgatgcacccctgttcctcgaatggaatacatggcgagccatgactatgctggatggaggaacgattaaaggcaatttcaaaattgatgattcgggtcgtccaacatcaacagcgcagggcaggctgcccacggcggtacaatagagatagggggtctccacctgggcaaagcccgcgggggcctggccgaacacgaacataacctcggtcacgcgctcattcgtggcaaggcccagagccgcggcgctggctgccaggatataattcttgctggtggagaggttatcggccagagtgcggtactccccgccgttcacacgataggtgatcttataggtgccggggaagttatacgtgccggtgacaacagtgtccagccgcacctgggcggggatggtatccctccaataaaaactgtccagccggacattggaggtattggcgatgccggagaaggtgtagcgcaccggctggccgcccatgatctccttggggccggtcttggtgatggacacgccggtggtcaggctcttgtttgtcacttcaaagcgcacgatctggccctcatgctccaggtaggcggtcagctcggtttcgttgacaccgtaatgctccggggccttgacctcccggatggtatagcgggagagggggagctgtttggacacggccagcccccggctgtcagagcgaatggtatcaaccagattgcccgccttgtcgtaaatctcgaacacggccccctccaggagtgttccggcgggcaggccggtggtggggttgtagtcggcggaccgcttgataatttggatctggccggtgatgggggtattctcccattcgatttcagtcacttcccccgccttgacatagacggttttcagttcggtgtccgggatatagccctcgtgctccaactcccggagatagtagcggccgccctcggtcaggccgtcaatgtagacatggcccctctggtcgctcacatactccccgatgggggtatgccgggcgttatacaacaggaaatggacgccggaaataccgcttccgtccgcagacgaaaccttgcgaatgagtatcccggagaagggcgcattggtcacggtcttacgggtggtttctccatccttcactgtgaaatagatgggggtgtcatccagcttgaagcctttggcactctcggtttccacggcgtagtaatcgccgctctccaggggcagatatacccttccactccgcccggtggtcacggtgtccaccagggcgtcatccgacacccggcggatatcgaaggtggtgttggggatgcgctctgtcttgtccgccgaactgaccttgatgagctccacaccgcccaccggcgtgttgtagaaccagagttcttgcgtatcatccgggttgaccaccacggtctgactctgtgtgtccgggtcgatggtatatccggggatgctctctacctcagtcacaaccactgtgccggtgatgccggagaggacgatctggccctccgcattggtccaatacaggccattggaggacagcttgccgccctcgtccgggagataggtgccgtccgcgcaggtgatcttgaactgtactccctccagcggggccttatccttgctggacagcttgtggatgatgaggttccccataggctggttgcggaactccaccgtgacggtctggccctcttttacctgaaccgtctggggggtgtcgtccagcaggtagcccggtttggccctggtctccttgatgaccagtgtggtgccgggctccacacctttcaccaggaaggtcccggtggagtccgtcacaaatttgccgttggcgtcgcccaccacggagccgtccgatttcgtcaccaggaactccacatcgctcaggggggtattgtctgctgccgataccttcttgaccaggacggcccccttgggggcgttggagaaatagagggtcataatgtcctggtcctcgccggagagatagaaagactggggcgcggcgtcaatgacatggccgctgtcactctccagctcctcgcagatgtagtagccctttttgagccccgtgacggtgaaggagccgttggcggaggtcacataggtccccactaccgttccaccggagccgctgacctcgccgcccaggtatttcagttggaaacggcagccggaaattccggcccccgtcacactgtcctgcttgtagaccaccagggccgacaggggcgtgttggatatggtgacggtcttgttctcgccgcccttgacatagacctccgtaaccgggtcctccggggcctgatagccaggggcgggcttggtctcctcgattttcagccagccgtcctcgatgccctccaggatgatctggcctgcttcatccgtctggaaggtccccaggtcccgcagctctccggtgtccgttttgttgctggcccaggtgatatggaactcggcatactggatcgggtcatgggtgatggaattttctttctgtacggtgacggtgggccgcttgtggttttcaaaatatacggtatggtcctggttggggtagagggtgacaagctggggctccgcgtccatcaggtaaggggacggcaccgatttttcggaaatttcgtacacgccgggcagtaaattctccaaaacggccgttccatccggcccggtcctgatttcgtccacgctgtggccgtccgccccctccactaaaaacactgtatcggctacgggctcgccactgtcggcgtcccgtttcaccaccgtcaaattgggccgcttgtcattttgcaggaccacagtagagtcctggccggggaacagctccacatggtactcggtcgtgtccagcaggtgatccgacacagtggaggtttcaattagggaataaacgccaggctccaggccctcccagcagatttcacctgtgctggaagtggtgcggtccagataccgggagccgtcctcgattttggcaaggcggtaggtcacgccgcccaggggcgtcccgtccgcgctctccttatataaatgcagagagggcagcttggaattggtgaacacaaactgggcctgctcgccgccgtccaggtggatggtgcgctgggcgtcgtccacgatatagccggggcactccagttccgtcacgatgtaggcggtatcggcggggagcttgctcaggtcgatggttccgtcctccagggtggtgtattccaccgggccgaagctgccgtccaccgcctcaaaacggaaacgggcgttagcgatgggctgggagaggtccgaactgtccaccttgattaaatggattccgggcaggcggtcgttaaagaaaaccaggtccttgatcccgtccccggccttcagctccacctcttggggggtggtgtccagtacatggccgtccccgccggtgtcccgttcctcggcccggtaggtcccaggctggcagttagtgagcaaaatctgaccgaactcgtccgtctggaagatgcccaggctctcggcgtcccggaaaatctcgaaggacacattgggcataagggtcatagtgccccgctcatatttcgtgatccgcagtccaggcagttccttgttgactatggtggcgctggattcctccccggccaccacggccaccgtctgcaccgtgtccgtgtccgcaatccagccctcaatacctgcggtctccctgacttcccagccgccgggggccagttcatcgaacaccaccacgccgttgcgggtctgctccgtccgggtctccccggtctcaatgtgcttgatctggatggtaacgccggagagggcgtcgccggtgtcgctccgtttttccacccgcagggagccatagggggcgttggtaaaggtcacgatggcggtcttgttatactccacatcgacgtgctgggtggtcttctccgggagcaggtgataccggggcgggatatcctccgtcacggtatagtggccctccagagtcagagggatcaggacctctccattctcatcgctggagaaagagcctactttgcggccctccgggtcaaccacgctgaacacagccccctccagcggggtctccgtcccttcctccagcttcacgattttcagcagggtctcgcccggcacatcttccgtgctatctgcgtaactgctgatggcggccagctccatctggcggttgttatccaggtcgcagatataattttgcagattgccgtatcggtctttttccaggcagacggcatacatggctgcatactgggccacggacgcggagagggagagctggacgttaccgctctgcccctggatgctgcccacggggtacagcaccttgaactgcccggcgtagccgtcgctggttccctcagtggtgacagcggtgatctcgttgttgttcatgtccacgatcttcgtgccctccggcacctcgtcgggattggaaaaggccacggacacgtcgtaatcatatacccacgtctcgctccagacggtgaacacctgctgcttgtattcctcgcccccgatggtcacggggtaggccgtggatttgtccgccgtgacggtcatgcggggggtgagcatatagttgtaggtagtgccccgcttgtagatgtccttggcggcggccaggatgcggtttccaatgtccagttcactcccggagaggccgggggccaccttcaggttggcaatgttccagtccggcatcaggtaacaccacagcgccatttttgtggcgtaatacgcctggtacttattgtccagcttcaactcgcccaggctgcggtgtgggtagccgttggagataatgcccaccaccttggggtcgcttgcccgttcctctgccaaatacttgatgctctcgccggggcccacggtctgcggaacgccgtactggtttgggttgacgcagtaggccggggactccttctgcgtgccatcgttggcctcatagagaaaataggtatagatctgctttcggacggagccgttgatggagagataacccagctcatactctccattgtagatattgacctcgcccagggcctcctcctcactgtctgcggcaaaggccgccgtcgggaggataccaagaagggtcacgagaaccaggaacagggatagcagttttttcatattgcctcctaaaaatgggcagaaggaggcacagaaaacatcagcacctccttccgcaatcaaattgactttttaaaatgtaaaatacggaaattgaagatacaaaaaaaggcgtcaaaagtcccctcaaattgagggaagattttgacgcctcaagcctccacggcctggaccatccagcggtagtcccgctggtcccggacacaggtaaaaagtgtgagccggttatcgctggtggcggcggtaccgctggtgtcggtctccttcaccttctggacgctgaccacctcataagtccgtgtgcccagcttggtagtccaggtgatggtgtcgcccggttccagggtgtggagcttcccgaagtggttgttcacgccgcggttgtgcgcggcgatgcagcagtttccatcccacaggctggtgtcctcgaagtggcccgcgcccttggctaaggtcttgctgcccgtgccctcgtaaaccttgacgctcaaaccgatggcgggaattttgagggtgcccaggtgcccgccggagtaatagagatcgctggtcacatccgtccagcctgtggcggtagtcccggtccagccggagcccgtatcaacggcagggtatgtgacactccccacttgggagaccaaaccgccgccgtccagggctccggggaccagattaggggtcagggctgtgccggagccggggaggtaactggtgggtgtgccgaagccgggcgggatcagggctgtatttttgctccggtccacgttggggtcctcatgctcatagatggtggtatcgctggtgggccgggcaaacaggtaatcgtccggggcgtccatggtgtattccagggcgctggccggggtgacgcagacgaccgccagtatgagggcagccagacaaagggttttcagcctcatttgttgtactccttccactctttcttggatttgtacttttgaagcaggaagcggcccaggaataccaggccgacaacgcccgccccggcgggcaggaccagcagccagcgccagtcaaagccgccgccctccgcggcaggctgtgggatagcggttacggcctcctgctcctctgccaggccgaaaacggcggtatagagcacggtcccgctggtagtcttggtcacttctccggcgtagtccgccgtgacggtgtagccggtggcgtatttgctggaagcggtgccggtataggtggcggcggcgttgtagaagcccccggcctcctgccattgaacatccgccagggtgagggtgcgcccgctgtcctcaatagacttgggcaccagggacacatccgcctcggagagattgggataactgcgggtggcggagacgttccgggtggacgtggcatagccggacgcctccacctggatactggcggtgtccagggtgaggaggccggtatagccgtcctccgtgacggcctcacaggtggcggccagcaggggcatgatctcctccatgtccttgctcttgctgtccagggtcacggtttcggtgtaatacttgctgtccgtctccgtctggtcctccttgacaatatccagcagggtatagaggcagccggaccgctcaaagtccccggtggggatgagggccggatcatccataggagagagttcgtaggtcttgctgatcctgggctcggcccggtctccctccgtgtactccaaaacctctactgggtaaagtacggagggggtggcttcgggagagggcgcctcggcggccagcgccgggcaggccagggcacaggcggtcagcaccgccagaaacaggggcgcggcgcgtttcttcatgtgggtcaactccttcaatcaaaaaatggcccgaaaacttccctcaaattgatgggagtttccgggcaaagaaaaaagtcccctcaaattgaggggacttacgggttatcgctccggggcgtctttcctccgctccgggagtttgatgcggaacatccggcagtagtccttctgggcctccagttcacactcacaaataagtctgataaaggcggtgtcgctggggccttgggcccgctgggcctgctggagcgcggtaatgtagtcatggcgcaggatgggcgggatggagaccacacagtagcccctgttcaccaggatcagattcatcaggagccgggcggtgcgcccgttgccgtcctggaaggggtgaatatccaccagcctccggtgggcgtaggcggccagcaggaccgggtgcatggcgtccctccgtttgttcagctcctccaccagcccggccataaggccaggcacctcctccgccgtgggtgggacatattccgtgccggtgatgaacacctggccttcccggtagcgtccggcgtgctccgggtcaatgccgccgtagaacagggcgtgcaggcggagtatatcctcctcccggaattgcaggggcccgcccctggcggtctccagcatatagtcataggccctggcgtggccggtggcctcgtagcagtcccggatgggcttgccgcccacggtgataccgtcctccaggagcaccttggtctcggagagggtgagggaattaccctccagggcgttggaggtataggtcatgccgatgcggaaataggcgtccagttccttcacctcgtccgtggtgagggggcggcgctcccggatcgcctgggcgtatgcgtcgatacgctctaataaagcgttgccgctcatacagtcacctgcctttgagagaaagttcaaaaatattatatcatggggagcggaaacaggcaacgggaaacctgggggccaaaagtcccctcaaattgaggggacttttgaacggcgcgccccgcctgcggagaggcggcgacagacgcacccgttccccacactggcaaaagccgccgtcaggcggcttttggggcgtcctccccttggagaccgcataatccggcggacggccccggtcaaggcccgcccagtccgcagactgggcggctcgcgggcgattgcatggcaatcgcccggccttgacgggggacggcgggcggattagtctcccccacggggagacgcccccggtctgcggccttaccggctctggcgctggggcgggatgcggcttctctgctggggggtgatgttccgttcaatggagccgccgaactgcttgctcatcccctggatctgatccagggcgctccgccgctgctgggggtcccagccctcgtacagctcctccaggcgggacaggtccggcgtgtcccgcttgatgccaaactggcggcacaggatataggaaatgctctgggcgtccaggtccacctcctcatggtcatagtttgggttggcccccttggcgtggatgcgggagtgggccacctcagcggcgatggccgcaaatgcctcgctgtctgagaaagcgggattgacggccagctccatatttttgctgtcatagtaggcggccacgggcaggtcgtggtcggtggccacgggaacaacggagtaattgaggatggcgcgcagggcgatgctcatttccttgctgtcatccttcaactggacctttttcaggtcacgcccctgggtctggcggatgtcataggcgtccgtgaggcgatacccccggcccagggtattccgggcaaaaattttgactcccttgcttcgctcctggtctatcacgccccgattcagggttttccaccgttccgccgtaccgaatacggtggcctccgggtcctgaaacatgaccagggcgatattgcccgcgctgtatgtggggttatccccctgcatatccaggtacttcacatacagttccgggctgctggtgatctcctccactccggcgtcttgcatggcgatggtgttctcccggtccgcctgcatttccgccctccattggttgtcctgctgggacttttccgcgatgatcgcttccagatttgccataatgatgttcctcctaagatatattcatcttgattttggtacggtttttcccttggcctgcggggccctgccgggctcccgcatcccttccgacgccgcccgcagggcctccaggcgggacttgacggatggtttctcagtagtctccgtcgtcctcatatccgtactcctcgtctgcctggctgtcgagccactcccgcgctgtggtgaggagtgttcgggccgaacgcggggggcggctttttttggcgcttcttcctcctgttcctgggcgggggccgggtagctcctctgttccaggtagtggttgaccagcggcacatagtccacattggtcacaaggtccacgatcccgctggtggaacgtgtgtctttaatcacggagaacagcacatttttcttggcgtaggcccggaagtcctccaggtcgctctctttgatgtgaaaggtcttgagttcccggcccgtttgaagcagccgggccatgttggccttgccgtagagttttttgttgttttgggacagggccatcagaaaggcggccaggtttttgctcccagccgccagcattttaacagcagcctcggtgagctggatgctctcctttaccatcaggtcggccacttcaccgctgttatccatcttcttcacctcccggttttcaaatattgaatgacctccagaatggaacaatactgaactttttggagataccgctttctcatcagcttcaagtgccgctcccgctggggcccggcaagggcggaaaacgtctccgcgtcgcgggccgcctcccggtagtccagcagggtcacgctcccccagggccgtccgcccacaaacttctccacatggaggaacagggcgagcaccggccacccagcccggttctgaaaggccagccagcacagattttcataactgcccggctcatagacacggggcgggtcaaacagccaggacctctcacgccgggccagaaacagatagtccgccgcgccgccctgttgcagtttgagcagatccaattcaatgctccctgcctcggtgggctgatagagcggtatcaatcccagaatggcggtcaggtccgcgtggagcagttttttcataaggacgcctccttgcatggtctgggcgctgggcttccaccgccgcccggaccttggggatgtcgccctcgatgcgggcgcatagcttcaagtcccggcgcagcgcccgcaggtgtgtggtgatttgttcgatctccgtctggatttccccgcctccgtctccccgccgtttctgccggtataactgcccgcgccgttccgtgagggcgtctatctccgcctgtatcgcgtcatactgcatggagagctgggccgctgtctcgatgcggtttttacggagataacggaattgctcctgatagcggtccagtttcagcagctcctcccgcatggagaacgccgcccggtttcccggacggcgtttcgggtatgcccccagcaggcagaggtattggaagcagagggcttgaaagcccgtgagtttccttgggcggcggggcatcccaccccgcacccgataccggcggcccggctccagcagacgggaaaaagtagtggggggagtgtccggcggggcctcgccggagcggacggccgcaagccgggcctgtatgtccgcctcggtatagccgtctttcaggctgtccagacggatataccctttcccaccggggggaaggatagcggtgtgcttgaccctggggccggtttttacccgataccccatccgccgcagttggctgaggaaggactggtaggtgtaggcttgccggatggcctcgtccacgtcctgacggatcaggtcccgcacggtggccttgccctgtctggccgcctcccactcggcccggctcaccgggccgcccaggggctcactgggctcaataatggacagcccgtgttcccggcagatggcgtctgaggtcccccggatgcccacgccgtccccgccgtagtagtccttcagttggtcccggtacatggccccatccacaaaggagacggaattgaaaacgatatgcgaatgtaaatgcgctttgttcaagtgggtggaaacgacggcttcatagcggtctcccagcaggcgccgggcaaactcgacgcccacggcatgggcctggtccggcgtcacctcgccgggagcgaaggactggatgatgtggtagccctttcgtttccgtccctccttgccccagcgccgcttggtgtccatcatgtcggcgtaaacgctctcccggtcgcagttgacggcggtctcgaaacaggtctgttccgttttctcccggtccagggcatagtcgatggcggcctccagggaggtcttttccgggtcctgggtatagcccacgcatttgtccaggcggttgtgaatgactaaaatcttggtgtaggccattacagcgtgtcccggaccagccggaccgcctgccggaccagccgcgccgcctcccgtatctcgtcctgggtggccgcgcctctggcgttggcctgataagccagttgattcacattattgccgatggcgttcagttcccggagcagggcggcgtaggtatcgggaggccggggccggagattgacgcccataatgagttggcggagcatgggctcgatcttgagcccggcggtccgggcggtctctgtcagccgggcgtagtgggcggcgtccagccgcagggtgatggttttatagggcttcatcgaactgggcctcctttccggtgttgcggcctctttgccggctccggcgggggacttttcaaggggacctccttgcagtaggccctctctccgcaggcgtccttcagcagatgggccatgcactcgtcaaacgggtgccaatcccggtctccgctcacaaggaaatagtgcatattggtctcccggtacatcagcttggtcccgctctgatgcgtgagaacaaccacgccataaacgaccagatcatttgtccccggatatggcgagatgtctacggccacgtcacaaaatggagtgtcgtgggcggcaagcacggctttgatcttctcggtgttctcggcctggtggtcccggaaatgctggatcagaccaatctgtttccgcaggtcgttcaggtagttccgctggtcctggccgataaacagctttcgtccactcccgaacacgatggaataatcgttatggccccggaatttcccccggcagggggttttctccacatggtaggatgtttcaccaaacaggcgttgcagggtccgctccaggagcagggtctcgctccgtttctcatcaatcatctgttcaccttcagttcaggtatcaaatagcgcatatcaagaggatatgcgttggtgttgtgcgggggggctgtgcccacggaaaaaagtcccctcaaattgaggggactttcggcggcgcgggggtatcaggggcggagcccctgaccagcggcattttgctgtcaaaatgccatgctggcgcggacagcggcgcgagcgccgctgtcaccgtaccggggccgttttccggcggggcggtttcttgggccctttccgggcggtctccggcttttgaacactctcccggtttcggtgctgattcaggggcgtggtatgcagcttctgtgccatagtcggctcctcctcttgtggtgtgtcttgatggccggaggacagcggctcctccagcagggccgggtcgtcctccagaaaggaaagcatttcctccacccgttcttccagggaagcctccaccgtatagccggggagaaggatgccgttgacggagaagcgtctttcctctccctttgggataggcggggacacctccgtgaacaggtgggcgtaggctttgatcctgccttgcaggtaacgctccagctcctcttttgtggcaaaccgcttgtcgctctgcccggcgatcttccagccgtcgccggtgtagtctggggttggatgctggagcgtgttataatgaatatcccaggacaaagtacagttgataagagttccatccggcgttttattttcggacacacgatacgacattttatagaccatgttgctcaatacgttccagccgaattgattgaccttccactggttggacgtgtgctccaccggcaaggcccgcagatactccctggccttgcggatggctatggtctccgccgcctgcttccgccattcggcctcgatttcagagaattttgagaaaatggctttttcctgggccacgctggcctcctccatggtggtcaattcctcccgcggcagttggatcagttccgcaacacggtccgcctttttatctggatagtaatgggcggacatttcgatttcccatccaggggtgatatgcgtatatgccatgcccgccccctatcgcgccatagccagccgctttttatgcagcggctttttcctggcggctgggcgggcggctttggccggaggcggctcctgtttccccctgtccgccgtctgtgcctggacctggaccgggaggggcggccccgcctggggtttttcctccgctggaggggccggctcaccggagacgggctgcgcctccgatggtacggccatatcgccgtcctccaggcagttcagcaggtcctccagcgtgaccttttccttctgcgggaccgggggttggagcgaatacccttgcaggagttggccgttgacacaaaacaattcctttgcctccgccgggatgggcggggacagggattcaaagcacggcgcatactggtcgaatttgctctggatgtacttctgggccccctccatggtcttgtacttcttgctgccctcgtactcaattcgttccctggggctccgggtatagccccaatacccttgagacaggccgggggccgtgtaggacaactcccaggtcaatttccattcatcaccagacttgacgatgttgaatgtcattttatagaccaggttgctgatctcccaggagccgtccttgtgcctctgccactcattgcgggtgtgtgtgacctccggcgttttcagatattcgattgctttttgcaggagaagggtctgcgccccatgctcatcccaggcggtgacggccttcttcatctcctcaaagactttcttttcctccgcctggctttcctttaactgcttttccaggtccttgaccgggacattcaggaacggcttgaagtcggccctgtcgccccggtagttgatctgccgcctgacctccaggtaaaagccctcccgaagataaccttcactggagccgatctcataaaacgatttttttgccatactgcaattcacctccctatctgaccgggccgctgggcggcgcccggtcctttttcggcatccagcccttttgataccgatgctccatcatgatcgtgcggaccagagccgcctcgttttccggcagataccggatgcgccggagtgtcccgtattcccaaaacaaatcttccatggccgccctgtaccgttccggctccatagaaaaccgccgcccggagtaaaagaccagttccacggctttggcctccaccgccgtgtgttccaggcggtggaggtgtgcggaaaaatcgaaggagcgtatatcccccgtggggctgtcccggtccctgcccttgaggatgacacagtatgcctcctctccggcctccgggcgctggctgatccatacccggtggccgtgggagccgcgaaggaacacatcccgttcccggacacacagccctccgccggaacgggggagccagtagaaggtccgctcctccatctcgtattccgacacagccgcctggagcgtccagaggtccgggcggaaacttgctggggtggagggggtggtccggccgcacaatccgtccaaaacaggaaacaatttaatatttgtctctttcatcttaccggctgcaccacccttgtccggctgtgccaccgctgttccgggcgcacggccgggggcggctggtagtccgggtccaggtacttggcctcaaactcagccgccgtcaaccgctccgcaccctggccctgtacgaagtcgccgggagccagatccagatagccgccggatggcagggggagggggctggcggtgagcacggtgccgaagtgctccaccgtgatatgcagccccagcaagcccggctggctccaatcgtccgggtctgtctgcatttcatagaggtgcatccacggggggagtgtggcgcggtccacccgccgggtcgtaaacaggccggggacggtcaagatttccacttcttccaatcgttctgtgtttgcgttgacaagatacataaaagcgcctccctgttatcttccctcaatttgaggggactttttaggccgcgggccgcgggtgtaaacaaagggatagtcttgggccagccggcattgtctggccagttcctccggggtgacgcgcttgcccgcgataaacttaccgggatggacataccgtgtcatgcgcctgttctccgggacatgattccgcatctcccagatacccaccacctgggcctgctccgccattgtccgtcgcacatccgggttatccctggatggccgcagttcatactgatatatttgatccggggtaaggggggaacggtaaatgacctccccccaggcccggaacgcgccgtgctccacgctggtacgctcgtcgtaattaagaaatcccgtcagggggttatccgggtccttgggataggtccctatgtccacgggccgctgggtggaataatagcggtaaagctcctgctgttccatcgctccgccctcaacgctccgggccttttcgcggtttgggccgcctggcctttggctttgggatggcgcgctcctgaacctcccattgcatccgtctggcgtcatactcgcttttggcaggtctaccgggctcaggaggagccatttcgacttgtgtaacagcgggtgccggcctcctgtcttttctaagctgttgcagacggacctttacggacgggctgcacggggcgggtcccgcctccctctcctggggtggctgcgtcatgtcctcctgcggagacaataggccctccgcagaaggggcctcccgctggactgcgggctgttcctgcgtttttcccatattgatggacttatgcaggcgtttcatgatctgctgaacggcggagcgaaatgcttcctgctccccctccggcagaagggccgcctgctcctccatttgctttcccaggtccgccgcctgacaatggcgctggaaacagggcagaaggccgcgggagagctcatcgacactttgatggataaaaggcgtcaattcttcctgtaaaaccgtgcggtattcctgcggcacactctgaaataactggtttacccgtgcctgcccgtcttggtatgcaccgatatgggtctgcatctgttccagaagggagccgcccgccccgatttccagagggagccagtagcggtctgtccggccgtctttcacatagtcgatcttcaccttgaccgcctgcggcgtccgttcagcctcccggtactcctgatccacctggcgtacataattctccgcttgggagagagacatctgtttgccagtgggaaaacgctcatccatgctctccgtgatggtcacaataggctcgccctccgggtccaggctgaccattggggcctccgggccgccttccgcgaagggcggcttcatcaggtcgtccacagcggcggaaatatcgtgggcaaatgctttccacttgtccgccaccgcccggaccgtacaagcccctcgtttgaaaaagccggtgaacaggctggcgctctcgcccagcagatcctttacatcctgcttcagattgccggtaatctccttcatccggctgttatgttccatgctgcttcactcctatcgaatggttttggaaatctcccctcaaattgaggggacttttgaggtccgggcccgcttcttcctgcccttggtacgcctcttttggctctgcggcacaggctccgggggcggacggtccaggcagcggctctcaacgccgtcgatcagttccgcggcggtgttgcgaatacactccagggaggcgcgcagctccgtttgctctctgccgctgctccacccggtaatgtagccgaaggagtagtctctggtgtccaggcccaggtactgacagacggtataggccacgctctccgcctccacctcgcgggtgcgccggtccttctcatgggcccctacgatgatcccgccctccaccgggagggcgtgcagcttggcgtgggcgatctcatggaccagcgttttgatggtctgggcctcgctcatgccggggctgagggtaatcttctgttccgcgtggtagtacgccccatggacgcccggcggcagggggccctcgctgacagggacgggggagatggattttaaggtggacagtagtttttcatagccctctacggtgcctgtcaaggactccacacccaggctggggagttcccgtccctctgtctggctgacatcaaacaccgtagccgtggtgaaaccagtttttttcacccatttctgttccttgatggtctgcccgtccgggccggtctcctccacctcatcccgcgcccagtaagggcagggggccaggatggtgatgccggtctcgcccgccttgacatgacggccgaatttccgtttccagtccccataccctgccaccatggaggcgtgcggacactggagcttaatgagaaaaatattgccgtaactgtaatggtgcagtttggagagggattgcaggtaggccgcgtactggccgctctggaacaggccggtgataccggcctccagttgatccgtcagcgcccgcacacgctccatacgctcttgaaagtcgatttttcacacctccccggaaagtcccatcaaattgagaggacttttgaataggaaaaaaaccccggacatggtacgttaccgctccatgccggggtctttcctgtgccgccggggcttccagtccgggtgtccgggcggaagctcctccctcagttcatccacccgctgtttcatattcttccgggcggcctgctcgtctccgaaataacggccatagttgtacccctggaaattgtcgtaggcataacacttccaggtgacgtagggggagacctccgtggggctgtaccccagcaccacctcggtatctcccacccggcggctgtcgatgatctcatagctctggcacattcgttttccgttcatcctgttcacctcgtcggcgtctcagccttttttacggttttccccgccgcggccttggccttttggcgctccatgaccgtctgacgcagcttcaagccctccaggatgccctgcttcacgtcggggatggtggtgcgcttatcagggaagaagggccgcaggtcctcctccagcattgtgaccttcagcggaggcatttcctcccgcttggtgggggccacggcctgcacgatcttctccgtggtcagactgcccgcctggctctccttcttcaactccttggccttggtgccggaggggactttagcctccttctgaatagcgtccgccagcaccttctgctccttgggcttcatttgggcaatatccgcgccggtgttgaccgggatcttcccctcgtccaccaggtcctggagttccgggaccagtttattcaaagtcttgtaccgctggatggtggcggggctctcgcccatctgctgggccagctcctcgtcggcgttcatgcgcttgatccccagggcctcgtcctgcgcgatctcctccttggtccggcggcccatcttccgtttcatggcgtcggttttcatctgataggcgcgggccttctccatagggctgatctcctcccgcttgaggttggagtccaccatggaaatgatggcctcgtcccggtccagattgcggacgataacaggaatattttcaatcccggccaactggcaggcgcgcatacggcggtggccggagaccatctcatagccgccgtccttatgggggatgaccatgaccggctccagcacgccgaatttcttgatgctgtccaccaggtcccacatatccttgttgtcgcggactgcgaaggggtgcccttcaaagggccggatattcgccaccttcatggtcgtgaccgtctccggctggccctccttggtcagggggattttcaggttttcgggcagttcttcatcccccacggcgggggcttccggggccttatccgccttggcgggctcctccgggggataagggaccagcttgccggggaccggcatgagcggcttatcccggtgccccttacggtactcactggcttgggcaagggacatttcatacacatccgcccggacctccagcatccccgcctgctccagcgccttgcagcggtggaagccgtctaccagttgaaattcgtcctctttctcgctcttgcggagaatgacgggcttttgcaggccgtttttcttaatgtccgcgatcaggccgctgtaatccttgcggggttcgtccttgacataggtgccgggcaaaggtttgattttggagagggcaacgaaacgcaggtcgggggatcgtggctcctgctccttttcgtccttgggcttactgggatcagacacaggagacttcttcccgtcggcaggcttggcagaggtgtccgtgggagccttgggctcctcctgtcccttcttctcgttggtaggcttggcgggggtgtctgcgggggccttgggggcttcctgccccttcttcccgtcggcaggcttggcggaggtgtccgcaggggccttgggggcctccggccccttcttctcgttggtaggcttggtgagggggtctgcgggagccttgggggcctccggctccttcttcccatcggcaggcttggcggaggtgtccgcaggggccttgggggcctccggccccttctttccatcagtgggcttgggagtagtgcccgcaggggccttgggggcctccggctcctttttcccatcggcaggcttggcggaggtgtccgcaggggccttgggggcctccggttccttcttcccatcagcgggcttgggagtagtgcccgcaggggccttgggggcctcctgtcctttcttctcgtcgataggcttggcggctccagcggcaggcggttttcccgcctctggaggcgcgggtgtgtccggcggcgcgccggggaccggggcgcggaacgctccgatcaaagggtttttcttggggtctgccatagtcgttttcctcctttatgtcgtggcgttttattgaaaacttccctcaatttgaggggagttttgctcgtttgggacgatccgtggggaaaaccgccccctgggtgtgcttggcggcgggcaggtcggccagtgtggacgggaggccgtcaaagtcctggtcggtccccaggatcgaggccagcagcaccacatcggccctgtccacgccgtacctctccgccagccagtccaggtattcccggcggttggagtagtcttttgttttataacggctcatagggactactcctcctgttcattcccgctgtggataggaaaagtcatgttggactgccgcctgataataggggctcattgtgactggtgcgttatatagggcggtcaacagataggcgcggatattacgtatctctgttgtgttgcgtctcatgcagtcaaacacatattccaaatggccattgtccaacatttgcagccgcccttttacctgctcggccggcatttccgcccctccaatgcgaaaggtaggccgggtgctgcatagcgtgtccacgatcagctctgtcacgctttccacgtcctcataaccaaactgctggcagagaaggggaaattcgattgcttcttgcacttctctccggcactcgcttcgatctatccatctgctctccgggactgtggcagatggatggatagatggataaagctgactgagatcagtctgattagactcaatataacttgtgtccgattttcggaagtctgcacttccgataaccggaagtcttgacttctgtttttcggaactcttgacttctgcttttccgaagtcttgacttccgaaaatcggaagtctgggaatgtcttgcggcgcagcgggttgcggcggtatggcgcgggtggtgaagcgtttgacatagatcttagtggggcggccctgcccctgcttgacccgctcaatgaggccgaagcctttcttgccggtgtccagctctgccaggagccggaccgccttttcatggccgcagttcaggtcctcttgtatctcgtccagggtgtagtagatgaacacacgccccatatcgtcataccagccgtttttggcggacaggcccatgcggtccagcaggaggccgtacaagagttttgcgtctgtggacaactttttgaacgcctccccggtaatgagctgccggggaatacggtagaaagcaaattgattgctctcgtcgccatagtaataatcgaagttcatgttctgcctcctgtcgtttgggcgcaaaaaaagggcacgaccctttcaactggatcgtgaccttttcaatgataaagttgtttggccggattgttccccggagcagcgtcaatctcgcatatgcgctttcagacaaatagttctcttttctcttaattttctcaatttgcgataaggtctttgaggggaataatagtggataacatgattttcacctcagaagtatgcggtgtggtgctcatagcacctttcgacaaaatctcccgaccgccatgctccaccattcgatttattgtatttttatcgttgttttttcgatgtttttctccgttttctttttatcatagaacattttcgctaactacgccatggagaccggcgtgctgtggcagacggtatatgaaaaggtggccgaggaataccctgaggttcactatgagaccatgctgattgacggctgcgccgcccgcctggtgagcaggccggggtattttgacgtaatcgcggcagaaaatatgttcggcgatatcctgtccgacctggccaacagtgccgccggctccatgggtattgccggctccggcgacattgggagcgagggcaagggattatacgagtgcgccggcggctcagcgccggacattgccggccagaacattgccaatcccattgccgagatcctctctgcggcactgatgctccgcctctccttccatatgaccgtcgaggccgacgcgattgaggcggccattgtcaaggttttggacgacggataccgcaccggcgacattatgactccgggaggcaagcggctctcctgcagcgacatgggggatgccatatccgaggcgatctgactgtgggccccggtgcggcctgaaaaagggaggttccgctatgcgcatcgaacagcttatcgcattcgataaagtagtgcagcacagctccttcacaaaagcggctaacgagctctacaccacccagccctctgtcagtaagatgatcgacgccctggaggacgagctggggcaccaactgctgcggcggacgagccgcggcatcgagctcaccgcctatggcaagtgggtttacggggacgtaaagatcattcttcaaatggtgaacggctggcaggaatccacccctctggaggaggttccccgggaggtacacatacagagcaccaccaccatgtgcaattttctctccgcagggtttatcccctgcctgaaggaccggcaccccgacatcaatctgctgctccacgaatgtcggcgcagcgagatcattcacaaaatggaggagaacggggttcacatcggcctgctcccgatccgcaaggaaaatcaggcggactcgaccgccaccctggagcggatccgcaaaaacggctgggactgctgcgaggtgattgaagacccggaatacctgtttctcggctccggccatcccctggctctgacaggggaaatcacgcctcagatgcttgcgcaggtgccccttggcacctattcccatgtaaacgacgacaactggcttctgttcggacactatttcagtggagaggccggattccgctgccacagcaaggacgccatcttgcagtatgtggcgcagaacaggtgcgccgctatctttcccaggtttacctcccagtacgagtattttgtcagccagggagcggtgcagcccgtcatggttcatggactggatttcggacatgccaccttcctgctggtccaccaatcaggaaagtccctgcttcgggaggaacagtcggtggtgtgtgcgctgaagcgatacttcaaggattgtacctgcaaataaaaaggttgaaaggccccgccggtatcctgttgggataccggcggggcttttcacgtatgctccagaccctgctgcatcagaacatgacgtttgccatggggaagatcacggccagaataagaaccagggtgatgccgcagcagacaaggccgtatttcacggcgtcacttccgggaatccactccttttcgccgtggacaatggccgcaggagcactggcgggcggggttgccatacccatattggtggccagcagcacacagaccgccagtgccgccggattggcgccgcaggcgatgcccacactgtaggcgatgggcgtcagcatggctgcggtggcgatgttattagccacgttggtgagggccatacccacgacacacattactgcggtgaggacgagagggctcttgccctggaccaccggcgtgatcagctccaccagccaggccgagattccggtggactcggcggccatggcatcggcgatactcagcgcggcggccaggatgaagatgatggaccagccaatgttcttggagaacagttggacggcaggcatgccctccttcagactgaccatgatatagacgccgacagcgcccagcaggatgccggtggcgcccacattgttcagcaccgtactgacaataaaggtcttgggcacgaaggaggggaacagcagcaggacgatcacggccacaaagaagaccatgataaatttctgataccggctcagcttgggcagctcttccatggatttgttgctggaggcaattacgctgacatcgcaccggaggacaaatttcatcagcaccagcagcagggccatggtaatagcggtgatgacgaccacgatcgccagataggggacaagcgcgatggagtcgccgccggacatctgggtatagctggagaacaccacggcgggcagagacttgaacggcagcagcatgtagaaggagcagcccacacagattgtgcccaccagggtgatagaggcccacttgctgccgggcttaacgccgtagaggcggcagatctccttgatcagggggaaaattaccatggtggccgcagcgcaggaaaccatgatgaccagcgcgcacatggctaagaagatcatcagggtcagcagatatggcctgccctgcacaaccttgcggctgacgatccagcgcgcgatatactcagtgataccggcggcgctgatgatgttggtaaaggcgaagaagaagaacagcagcaggacagtggaattgccgaagccatccctcaggacggcgggtacggtggagtagctgctcaggcccaggaaaagcaggccgaaaatgctgggccagaaggagtcgttggcgatcagccagccatagagcatccccaggaagataccgatcacctccaccccgagaggggtcagcggctccgcggcggggacaaacttgaaacagaccatgattgccagggatatcaggatgtggatcaccttgatcggagtgagattggtcaatccttgctgtgcattcagttgcgtactcacatttgagacctcccttgaaagttgtatttatctcaggctggactcacacacgctccagctccaagattctgcgggcgttgccggccaggaaagcaggctgggcctcgggtctcaggcgcccctccaggaagtagtccaccgcctcccgcagggagacataggggtaggcggaaccaaagagcatctgatcccgcaggatatagttcgccgcagccaggtactctccgcttcccgggccgttgaactggtacaaatccggcagcagatagacatttttatagcgatacgccacgtgaatggcctccgtcacccagggccagcctccgtgggagaggatgatgttcaatttgggaaacgccttggccacccgctcggcgtgctccggcttggagtactcgatgtccgggccgcagttggagcccaccatgagcatgacggggacacccagcgcctggcagcgctcatagagcgggaaaatccgttcatcctccacgaacatgggggtcttggtcagtcccggttccatgacgatgccccgcaggccctcgcctacgacgtaccgctccagctcctccatggcctccggcccgtcgctgggatccacccccgccatgccggtaaaccgcccggggtaggcgtggatcaggtccacgatatcctgattgtccacaacgccgatgtgaggaagtaccttgcgtccggccagcaccgccatgccgatgcccgcccggtccatttccgttaaagatgcctccatatccctggcagccacagccggggactggttcataccgaacgcctcggaacagcgctttgcccgctccagatcccggtacataatggtctcccggtagctgccatagggcggacggtaacgaaaatcaatgatatccatgaaaatcactcctgtcccggccgcaggcccaactcagcccgcagctcgtcgttgaggcgccttaccgcccccctgtccggcggctccagtccggccagtggatagctccggcccagctggcggtattttccctccccccagttgtgataggggagcagctggtagtcggccagcgatgggagcctccgcaggaactgcacgatttcggacaactgttcccggccgtcgttgacgccggggatcagaggggtgcgcacccggaggggcaaatcagggaattcccgggagagcgccatcaggttgtccagaatccgccgattgtccaccccggtgtaccgcctgtgtacctccgaagccatacatttgagatcaaaaaagataagcttgcaaaagggcgcggccttctggaacgcctcaaagggcacgtatccacaggtctccagggccgttcccaccccctcctcccggaaccgttgcagcagctcggcagcaaaatcgggctgagccagaggctcacctccgctgagcgtcacaccgccttcggcgcgccagctcatgtgctgggccatcacccgctccaccagggtcctggcgtcaagctcttcaccgatccggctcagcgcgccggagcagcaggcccgggcacaggcaaagcagctccggcaggcggcgcggtccacctgaatccggccgcctgccgccacggcggcggccccggtggggcacgcagccgtgcaggcccggcagccgatgcatttggaagggcggcagctcaactcaggctccgcatgctgtgactccggattggcgcaccactcgcaccggagcgggcagccctttagaaaaatcagatcccgcatgccggggccgtcgtggaggctgaagcgctgcacattgaagatggttcccactgcggattggctcatgccgccccacctccctcctgcggatggtttattcggtgcacatgctggtgtgctcggtacggttgataatctccgtctgtagcttctcactcaggtcggtgaagtaggcgcagtaacctgccacacgcaccaccaggttgcggtatttgtccgggtccttctgcgcggccagcagggtctcccggttgacgacattaaactgaatgtgccacagtttcagatccacaaaggtgcggatgatctggataaagttctgaataccgctctccccctccaggaatgcgggagacagcttgatgttcagcaggcgctgcatcgtcaggtcgtgggcatggctgttgatggccgccacggcgttaagcgtggtgatggggccgttctcatcggtgccctgggtgggggagattccctcggacagggccacgcccgccctgcgtccgttgggtgtggcaatggtcttgccgcccagggccacgtgggaggccaccggcacaaacttcaggtgcttctgtccgccgtgcatggtgcggtggcggacaatgacgttctgcatcatggcgtcaaaccggcgggccagctccagggcgtgctggtcgccgttggcaaacttgggtgccctgagcagcttctggcgcatgggctcatagccctcaaagttggcgtttaccgcctggcggacctgctccagggtgaattccctgccccggaatacgaactcatccagggcggagagcgattcgatcagggtgccgatgccaatgacattcaccgcaccgttgtcgatatacaggccgtagtccctgtcacagggctggtgcagatccttcatgttgatccgccccgcctcgctgagggcggaggtaaaggggcaggccagcttcagggcgttgctctgctccagggtgccggtgcgcttcatgatgtggcgcacaaagaaggtaaacgccgcctccaggttgaccatcagatcgtccatgttctgaatctgtccggcggggatgggcgtatccaggaatttctcgtacttcccgtccccaaagtgaacccagccgtcgctcatggccatctccaggacggcggtgatgttcaggttgcacaccgcggccaggtaagtctcatagtcgggcaggcggccgccgcagcagccacaggcggcatagtcgcgggcaatgtgcagcggcacgccggcggcgatgtagtgggtgataaactcctcgtcgttgaagaacttggggcagccgtatcccaccttcaccacctcggcggcggcccggagcagcttatccggggtattggcgtgaacccgcaggctgacatcgggatactggaaggggaactccttcttggagcggaggatgaggtaggtcagtggattggtggcgtcccggccgtcgggggtcaggccgcccagggaaagggcctcaaagtgggtgtagccctcgtggccgcccgccgtgctcttgccctggtagggaaccacctcgcccaccttgatgaacatgcattccagaatctccatggcccgctcctccgtgagggtgccgtcctccaggcccgccttgtagagggggtagagatactggtccagtcggcccagacccacgccgccgccgttcatgttctccagccggtagcccacctgaaggaaccactgggcctgcaccgcctcatagaagttccgggcggggtgctcgggcacatggcggcagatctccgcgatggtctccagctcggcccggcgtaccgggtcgctctcctccgcggccatcgcctcggccctgtccgcatagcggtgggcatatgtaatcatggccttgcaggagagaattgcggcgtccagatagtagatcttgtccatctggttgtgcagcaggttgccctcgatgcccgccttcttctcctccagctcgcggatgatgctctccaggccctccctgattaccttttcataggagccggtccagctcagtgtgtgggcgttgttggcctcgtcgaagatgaggccctgggtggcatactccttgtcgccgtagatcaccctgcgggtctccctagggagcatgttcagatagagctcatgggaggtcttgcccttccagtacggaaccacctcgttgagaacggtatccacctccgcctgggtcatggcgtagcccgccttgccctccgccttgaggatcttgggcagatcacgcgggaactggccgccccgggtctcaggatatagcacacagtagcggcccggaccgccggccgtgccgacaatgagctcatggggctggatcaccacttctatgtgctccatcatgtactggatggccagcgcggtgcggagcacctggggataggcctccgtctgcatcatggactgcgtaaagagcaccgctcgctggatatccacccggggcttctggccgtaaaagcggtcctccatgatcctgttgatgcgcggccgcggagcggagagctgccggccatcctgaatccgctgctccaagtcggtcattacggcggtgtgtgcgtttgcactcatagaacgtccctcctatgtggctgccatactgtctaaattctccagttttacagcgctgaacagccctatttctgtacttatcataaacgacatggctctcagaaacaaattcacagttttcaccgccccattccagaaggttatcctttatttgcgtaccttttgcatggaaaccattggacgcatatcagttctccaaaatgcaaaaagggcgtgtgccgcagctaagctgcggcacacgcccagttggctggagccgttccgccgggaactctcaacaggaatttgccagcgataaagacccctctggagcccggccgctgtccggtctccagaggggcttctgttcgtcttctctccgctcaaacgcccctcaggtcgccgtccttcatgcagaggtggacggcggcggtggtgaaggtgcggggcagggccaggatgttggggttggggccggtgtacttgcgcatggcgtcggccagggcctcctcgaaggtggcgcgggtcttgaggcccatgctgcgggcgatgcccggctcccgggcgcccacgatgtagatggcgctggtgtgctcctcggccagatggccgcagctcatcatggagaagccgtggaaggggtggaaggcgttggcgaagcggtacttacggatgtactcctccttggtggcgaagtactcgccgtaccggttcatgtcggggaggatgttcatgtagtcgtgctggaacaggtcgtacagctcccgcaggtagggccagcgctcgtcgtggaagtagccgtcgcagatggaggagacgatgaacacgcaccggtcgctcatgatgcgcctgtggcggatgacctgggcggacagggcctgcatcatctggatggggttggtgcccatgccgttgccgtagtggaagttggtgggcatgccgaagacgatgatgtcgtacttcttctccgcccagtggacgtaggtacgcttgtccgccatcttccaggacacgggctgcatctccctggcccagccggaattgatctcgatctggcggctcttggtgtccagcacggcgtcgcagcagaagaatttcttgcccatcttctcctccatccgcatgccctgctggtcgaacttgtgccgcatctcactgttcgtggacacgggcacgaagtcctgccggtgcatcacctggggcacgtggtgggcagagatgctccgccagtgggagatgccggtggcgcagtgcttgtagccgccggagtagccgccataggggttgccctgggtgtggccgatgagcaccgccacgtccgcgtcatagacgtacttgttcatgatcacgtggtccccctgggcggtgtagcccaggtccaccaggtggtcgtagtcctcgctgtcgtggctggtgatctggccggtggggtagaactcgccgaacagctcggggcccaggatggtctgcatctcggccacggtggcccgggggtgcaggccgttggagaacagcagcagcacgtccttctgctccaccccggcggcgtacagctcgtccaggcaggcacggatggccaccttccggtggctggtaggctggttgccccccttgacgatgtccggaatgacgatgaccaccgacttgcccggcccggccagctccttcagcgggggcatgccgatggggttgcggatggacgccagggtagcggcgtacaggctgtcccagtcctggggcagacagggcggatccgctaccgtctccccggggatgaagatgtccgtgctgtcgggcagctccgcgcccagcaggccctgcccgtactcaaattccagtttcatgggcttctcctcttttcgtttgcagtttcccggcgctgtcccgcaggccgtggaacaaaacatcgctctccccacgcaggcgctggagttctttcggcgtctccaccggcatgcgttccgccaggaaggcgaaaatccggtcggcttcctccggagtctccttcaggcccagctcctccagacaggtgggcatacccagcgcccgcagcacccggttcagcgcctcctgcgcttcctttggggccccgtttaccgccagttggtagaccagcgtactgcccaccagctccccgtggaggaatccggcggccagttccgggtgcacacagcagaagtagctgtagagggtgtggctcacggcggcctgcttgccgccgcaggccatggcggaaatcacccctgtcacctggagggccgcgcagacacagtcctccagcgtcggtgtgatctttccggcccgaagctgctcaattgtctcacacccatgctccagcaagagccggtaggtgttttcagacaggagctgggcgctctgggagaagaggttcttttcccactgattggagaattgaatgttgtagctgatttccgggtatttcgccatggcatccactatgcctgccgcgtagagacgggccggacagtccctgacgataaagtccagctcggctatcacggcaaagggcgggtaccgggtccagttgttccccacgaacgcgccatcgtcagtgtactctaccgccagccacgctgaggcggcgcaggtagccgcagaggtggggacgttgatcgcccgcacccccatatggtcagccgctattttagccgtatccagcgcgcggccgcctcccacgcccaccaccagctccgccccgtatgcctgtccggcctgggccgcacttcgaacattaccggggcagcagtggccggaaaagagccagacctttgtatccacaccgctctgctccaggctgcggagcacacgtgcctccaccttgggccacacggcggcatccgccactaccagcgcgcgccgccccagcagtacggcgtcccctcccagatgagagaggacgccgctgccttgatagtatcttcctgaacagagctgaatcaaattcccatttctcatatgtacgcctctgatcaagccgcagccctgcgggccgccagcttcttcttaatataggggaagaacaacataaacagcgacaggaggataaagaacaggctgatgggggaggtaaagaacgtcgcccagcttcccttggacacgatgagcgcacggcgcaggttggattcgcacagcttgcccagcaccaggccgatgaccatgggcgtcatgggcatgtccagcttggtcatgaagtagccgaagatacccacgcccaccataaagatggcgttgaacacggagtagtcgatggcataggcgccgatcacgcacagcatgaccagaatggggaccagggtgctggtggggacgcgggtgatgttgacgaagccccggatgaatacccggccctggaggtacataaagatattgacggcgatcaggcccagcataatggtgtagacccactccccgtgctgggtgaacagttgggggccggcggcgataccctgcatggtaagagcgcccagaagcacggccgtgttggtgtcgccgggaatgcccagggtcagcagggggatcagggtggcgcctgtaacggcgttgttggccgactcggaggccacaaccgcctcctcggaaccgtgcccgtattcctcgggatgcttggaggtccgcttggcttcattgtacgccaagaaagaggagatggccgcgccggtgccgggcaccgcgccgataaacacgcccagaatgctggacttgagcagcaccatcttgtatttcagtacgtcgcggaagcgggtcttctccttttccaccttgaccgccgttccggtggccttgttcatgtcccgggccttggccatgatctccgtgatggcgaacaggccgatgagcacgggaatggtatcaataccgccctccatgcggttgataccgaaggtgaagcggctgactccatccatgggatcgatgccgatgcaggagatcagcagccctacaaagcccatcagcaggcccttgatctgggactttccgcccacgctggcaataatcgtcagtccaaagagagccagggcgaaatactcggccgggccgaacttcagcgcaaagctggcaatgggcggcgcggcaaacagcagaaccgcacagctgaacaggccgccgatggtggaggcggacagtgcatcatgcagagctcttaacccgtgccccttctgagccatcgggtagccgtccagcgaggtggcagccgaggccggcgtgcccggcgtgttgatcaggatggcggtgatggaaccgccgtagatactgccgcagtagacgcccagcagcagcataacccccgggatggacgccaggccgtatgtgagcggcagcagcagcgccatggccatggtgccagtcaggccgggcagtgcgccaaccataattccgccggccaggccgacgttgatccagagcaggttctccagggtaaaaaggctgctcaaaacggattcaatcatgctcctctcctcctcttaaggcagtctcacggagagcaggaaggtaaatcccgcccagatggctaccgccgcggcatagaccaccgggtaggcccagatctttttcacgcggaaaataagcagaataacggtggctgccagaagcgtggagataaaataccccagaatctgaaacagtgccgcatagaccagaatcacagcggccagcagaagcgcccgcagctcgtcccgcagggcccgctttctctcctcctcggaggcaaaggttcccgtgctgtcggcgccgcccgccttgcggtgcttcacaatggtggtgagcatcagcgccaggctgagaatcaccatgcaggccccgataaaataggggaatacgcgcgggcccatgacggacacgcccggatcttgaatggtcagcggaaccgagatcaataccagcgctcccagtatcagaaagaaaaaggaagcaatcatatcctttttgtattgactcataagctccctcctttgttaaggtattgttctccgggccgcgggccgccgtcggtccatggcccggagagcgcttgctatgtgtttggcagagggatcagccggccagcagctcctggttcacggccgcctcctcgttaatacgttccaccatctcctcggtggtcagggtcagaggcaggagctggttggcgtcgcagaactccttgtactcgtcggtctcggtgatggcagtcagggtctcggtcaccttggtcaccacgtcctcgggggtaccggcgggcagcatcaggaacttccagacgctcatcgtcacgtcatagcccatttccttgaaggtagggatatccttcaggttctcacgtgggtcccgctcgtcgttgaagatgccgatggccacggcgtcaccggactccacatactgcatgacctcgccgggatgtccggtgcagacgtcaatgtggccgcccagcagggccgcgatggtgggagagctgccgtcataggagatgccggttgcctccacgccggccatgccgaagaactgcttctgggacagctccatcaggctgccgctgccggagaagccgtaggtcacggagtccatctccagcaaatcgtcaacgctggtgatgccggagtccttgcctgcaatcataatgatgggctcattggacagggccgccacagggataaagtcgtcaattgtgtaactgacctcgcggacgaagggctgaagggtaaacacgccgatggcctcctgacagagggtgtagccgtcgggggctgcgttcttgaactccgtggtagccacggtgccgcccgcgccgccgctgttctgcaccaccatattgacgccgaagtactcgtcgcgggcgccgatctcggagacaatgcggcacaggccgtcggaggttccgccagcatcccaggggcataccaccgtgatagtgctgcttggatagctgccggtgctgccgcctccctttccggtttcgccctgatctccgcaggccgccagaggcagcgccagcgacagggacagggacagtgcaaggactttcttcaggtttttcataggaatacctcttttcttcttatgatttttgccgcacaggcggcgggttaacaggaataacagagcgcttcccacaggccggccagatagcatacacccatcgcccggtcgtagaggccgtaaccagggcggccccgctcgccccacaccatccggccgtggtcggcgcgtatcacgccgtcaaagcccctccggtgcagggccgccagaatggccgccatattcaggcttcccgaggcggtcagatgtccgctctcacagaagtcctcctccccctcccagcggacattccgcccgtggacaaagggaattttgccctccgcacagaggcggtctgcaatcttgaccacatcgttggccctgctgctgcccagggagccggtgcacagcgtcacaccgttggatggcagatccaccgcgccggtcaggcggagcagatcctccagcgtggataccacccggggcaggccaaataccggaagaggcgggtcgtccgggtggatggccaggcgtattcccagccgctccgcctctggggccacagcctgtaggaaatagcgcaggttgttccacagccccgcctctcccaaggcccggtactggcccagcagcgtccggatttccccctgccgggtggaaaagttccagccgggcagcgtccagacatcccgctccgggttcatgcgctccagcgcagcctggtgaaaggccagggtggcggagccgtccggcaggggctgctccagctctgtacgaatccagccgaacaggggcatgaagttatagcagacggtatgcaccccatggcgagccagccgctccaggttttccacgaactgtccgatgtaccgctcccgctccgggccgcccagtttgatggactcatgaaccggcagtccctccgccaccgagaagtgcaggcctgccgccgcggactgggcggcccgggccgcgatgtcctcctccggccacagcgctccggccgggatgtgatagagcgaggtgacaagctccgtcaccggcgggatctggcggatatgttccagcgtgactgcgtcctcgggcccgtaccagcggaagccgaaggccgtcatcccacgtggcccagaagcttttccaggccctcctcaattgtccggctctcctccccgctcagatcacggaaggggaaccgggccggccccatgtggaagccctgcagctccagcatctttttgtgggccatgacgggcataacgctccgcaccagcccgcgcagcttcagaagcatccgctgtatccgacgggcctgctccagctcaccggcatagtagcaatcccagagctgctggcactgctttggaaacacgctggccatggcgataatcgcgccgtctcctccggactgaaggacggggagcacctgggcgtcgtttccggtaatcagctcgaagccctccggaagttccaggcactggaactcctgaaacgtcaggaaatccatgctgctgtccttcaggcccgccacgttggggcaggtgtcgcacacctcctgtaccaccttgggcgtgatggggttatgggtcatccccggcatgttatacagatacaggggcatcccctccgccagctccgcggccttgcggaagtaagcggtcagagtctcggcgtcatagctgtggtaatagggcgcggtgaccgacgccgcgtgggcgccctcatgcctggcccagtcaaacagctccttcatgtccgccagattcatggccgtggtgttgaacagaatacagctctccggccctgctccctccaccgccgccgtcaggagccttttccgctcctccaacgtcagattgacaaactctccagtggtgccgcagacgaagacgccgtgtactcctgcatccgtaataaattgggtcagccgcgtgtattccccgtagttgatgctcccgtcctcccgaaagggggtcaattggggggcggaaataccgcgcagactgcatattttggacatggagtccctctcctttcctgactgacgctttgtcagtccaaaatagcgcctctggccgccggctccacattgcgggcgtagcgggccagatagccctcagtaaccttgggctggtagggcggcagctcggccagccgccgggcgatctccccgtcggagaggtccacgtgcagggtcccggcatcgatgtcgatgtcaatgcggtcgccgtcttgcacaatggcgatggggccgcggcgggaggtctccggggagacgtggccgatgcaggggccgcgggtcgcgccggagaagcggccgtcggtcaccagcgccaccgactcagaaaagcccatgcccaccagtgccgcggtggcggtcagcatctcccgcatgccggggccgccctgggggccttcgttccggatcaccagcacttcgccatgctgtaccacgccgccgtagatggccttgacggcatcctcctcacactcaaagcagcgggcaggaccgctgtgcctgcgcatggcggccgccacggccgactgcttgatcactgcgccgtcgggggccagattgcccttgagtaccgtgatggagccgtggtcgctgtaggcgtcggacacggggcggatcacctccgggttgtgttcaaccacccgctccacattctggcggtgggtttttccgttaacggtcatctgatccaggttgatgagtccgtccagctcgcgcatcacggcgcccacgccgccggcctgatccagatcgagcatcgtatggctgccggagggcttgattttggccagatagggtgtctccgccgacagacggccgatctcctccagagacatgtgcagctttgcctcgtgggcgatggccggcatgtgcagcgtcatgttggtggagccgcccacgctcagtcccacccggaccgccagctccagcatctcctgggtgacgatgtcccggggccggatgtcttcctccaccaggcgaaccaccgccatgccgctctccttggccacccggttcttcttgccgctgaccgcgtgggcgcaggcgctgcccggcatcgtcaggcccatggcctccgcgatgatggacatggtattggccgttcccatcatagcgcaggagccgggggtaggggacatcagcccctccatgtactcatactcctccctggagatctctccgcgggtcagctttcccgccatctccttcagctcataggtgccgtactgcttccccttgtatacggccggcatcatggggccgccggtgacgagcacggtggggaggttgatgcgcagtgccgccataatcatggccggcacaatcttatcgcagccgccgatgagcaccaggccgtccaactggtggccgccggcatagacctcgatggagtcggcgatcacctcgcggctgggcagcacgctgcacattcccacatggccctgggaaaagccgtcgcagagggagatggtgttcacctcaaaggggacgcctcccgcctcccgcacgccgtccttgaccaactggccgatgcggttgaggtggatgtgcccgggatgcatctcgttataggtattgatgacgccgataaacggcttggccaactcctcgttgaccagacccatgccccgcagatgggcccgggggcccgccatgctcaggccgttcactaccttggagcttgggtactttgggtccttataaatcagatccatcggttcactcatgcaaatctgcctccctcatctctctttttcgatacccgaatgggatagtgccagcccagcttctctgtaatgcgggccgcacaccgcaatatttccccagagtaggacagcgccttttccaaggagaagcgatagtccggcgcggcaattccgatggccgccagcacctggttatccacatcaaacaccggcgccgcgatgcacaccacgtccgtatggtgctcgtggttatccactgcgtagccctgaatccggatcacctccagctcccgccgcagatcctccgcgtcggtcagggtcttgccggtgaagcgctcccgtttcacatgggccaggtagttctccagccagctctcggatttccacgccaggatcgccttcccaccccctgtacagtggagcggaatccgtttgcccaccgccgagtgaagccctacggagctctttgcccccagctttgccagatagatggcctccatatcctcctccccgatgaggtggatggtctccaggctcagatcgttcagataggccatctctcctctggcggcctcatagagaaagtttgtcttttggagctgtatggccagcaggcgcgcctcaaatcctgcccggtagcacttttttacctcatccttgatgacaaacccgcagtgctgcatctcctggagaatccggtgggtggagctgggcggaatccccgtggcggcggagagctgggccagcgaaatctccccctcgcagtcggccagcgccaccaggagctgcagggccttcatggagctgtaggtccgcatcaattcctgcaattcttttttgtgatgcatagcgatctcccaaacattctatatatagaaaaactaatttatatttgattttcgtttgtatattaactcctttttttcgccatttcaaggcgcaaaagttggtcaatattttccaaaaaccagctttttttgcaacatttcaaatatggaaatcatatgcgatatgagggacgcccttttgttttatttattctatatacaaaatttctttctcaaagtgcacaaaaaaaattactacttttctcccctccgctccggggtgcatagcctcttctcccacctgccagaccgtcccgcccaacaggagtctcccgctctgcaagtcaaaaaagtgactcaaattttgtatattatttacaattttaaggaatatcacaaaaagtccgcaaagtgtcttgactgtatttggtcaaaatgttatactcacctcgtcaaatgtaaacgattacatcagaggtgaaacaggatgcgtgccccaacgatttcggaggtcgccaaaaccgcgggcgtctctgtcgctactgtttccagagtggtcaacggcagtccctcggtgtcccatgagacccaggcgcgggtgcaggaggccattgagcggctgggctaccagcccaacgtgtggggccggagcctccggcggggcgagagccgggtggtactggtcatcgtaccaaacgtaagcaacccctactacgcccccatcatcgccgggacggaggaccggctccacgaggacggctacagcggcatgctgtgcatcaccaatgccgaggcggagcgccgggcgctttacctggaatttttgaaggacggccgggccgacggcgccattctgatggagccggcccgggacgacccccatgtgaccggcatggcccgccactaccacctggtacagtgcagcgaatactgcgacaaccaggcggtgagccatgtgtcggtggacaatctggccgccgcccgggaggtggtgctcaccctggccgggctgggccaccggcgcatcgggttcatcggcgcggacaacgacttcatgtccaccatcgcccgccggcagggctatctggacgggctgcgcgttctgaacatccccccgcgggaggacgaccagacctttgccggacgggattacagctttgcctccggcgtggaggccgcccggcggctgctggcccggccggagcgccccacggccctgttctgcatctccgacgtgctggccctgggcgccgtgcaggccgcccgggagctgggcctccgggtgccggaggacttgtcggtggtggggtttgacgatgtggagtacgccgtgatgggccaccccaggctgaccaccgtgcgccagccctgctacgagctgggccggacggcaggggagcttctgctcacccagattcagggcgggccccgtggacgggcggtctatctcccccacaccctcattgagcgggattctacggcacggtgtgccgttggatcataaaggaaatggatctcaatatttaaggaggaaacaagcatgaagttcaagaaactggctgcgctcaccctggccggggccatgtccctgtctctggccgcctgcggcggcggcggcggtgacaccgcctcccctgcccccaacaccgggtccccctccgccgccaccgatacccccgcgcctgagggcgaggtctacaagatcggcgtcctggctcccgaggtgacccacggctggtccgccggcgtggcctactacgccgaaaagcgctgcgatgagctggtcgccgagggcaagattgagaagaagattttgatcagtggcgacgccgccgagatgaccacccagttggacgagttgaagacctggggcgccgacgccatcgtggccttcccccagtgggagggcatggaggtgcccatccagcaggccattgacgagggcatcaccgtggtgaacttcgacatcgccatcgaggccgacggcgtgtaccgcgtgtccggcgacaactacgacatgggctatcagagcgcccagtacatcgtggacaagatcggcaccgagggcaccgtggtcatcctggacgtgcccacctccggctccgtggccgagctgcgcaagcagggcttcaccgagcacatggctgagctggcccccgacatgaacctcatcgagtacgcaacggaattcacccgcgaggccggcctcgcggacatggcggacattctgaccgccaattcccagattgacgccgtcttctccatggacgacgagacctccatcggcgtcctgcaggccatccgtgatgccggccgcaccgacattaaggtcatcaccggcggcggcggtgcccaggagtggttcaacatgatgctggccgacgagaaccaggacatctggctgcagtccgctctgtactcccccgacatggtggaggacgccgtggacatggcgctggatattctgaacggcaacgcccccgaggaccccgtgaagatcatccccaccaccattctggaccgcgacaccgtggagtcccacctggacgagaattctccctactaatcagatttcccgctgataaaggggctatggcaccagccatagcccctttcccgaaagaacagaaatggatgtgatcccatgacactggagatgcgcggcatctgcaaatccttcggttccaacgacgtgctcaagcacgtggacttctccattcagggcggggagatctgcgccctgctgggcgagaacggcgcgggcaagtccacactgatgaacatactgggcggcgtgctgcccgccgaccgcggtgagatcgtcatcgatggcacccccgtccacttccgcaccccctcggactccctcagcgcgggagtcgcctttatccaccaggagctcagcctgatcaacgatctggccatctacgagaacatgtttatcggccgggaactgaaaaccaaatacggcctgttggacgccaaaaccatgattcaaaagacccaggaggtctttgaccgtctggagctccacctggacccccgcaccatggtgcgggagctggatgcgtcctacaaacagattgtggaaatttcacgcgccatgatgatggaggcctccctgattatcatggacgagcccaccacctccctgaccgacccggagattgagcgcgtgttcgatatgatgcgcatgctgcaaaagcagaacgtggccatcgtcttcatctcccacaagctcaaggaggtcatggaggtctgcaaccggtacaccgtgctgcgggacggcaacatggtggccgccgggccggtggccgaggtgaccaccgccgacctggcccggttcatggtgggccacgacgtgcgcaccgagaacctgcaccaggacaaggagctgggcggtgagatcctccggggcgagggcctgagcgacggctcccacttccgggacatctccttcaccgtccacgccggcgaggtgctgggtgtcaccggcctgctgggcgacggccgcagcgagctgttccaggccgtcttcggcgacctgccctacaccgggcagctctttgtggagggtcagcccgtcaaggtgacctccaccccccaggccatccggctgggcatcggctatgtcccccgcaaccgcaaggagaacggcatcatcaaggacatggatatcgtggagaacggctccatggtcacccttccccggctggcccgccggggcctcatcgaccagcgccgccgggacgcggagtttgaccgccaggtaagcgagctgcacatcaagatgggcaaaaagaccgacctcatcaccagcctgtccggcggcaaccagcagaaggtggtgctggccaaatggctgtccgcccaccccaaggtgctgattctggacaaccccacccagggcgtggacgtgggtgccaaggaggagatctacgacatcatcctgcggctggcccgggagggcgtggccgttgtggtgctgtccagcgaggcccaggagatcatccgcgtgtgcgaccgcgccctggttctgtaccacggcgccctccagggcgaggtctccggggcggacatgaacgagcagaccatcatgcacctggccaccggcggcgcggcgccttccgcacaggcaattcatacagaggagtaacggctatgggaacgaaagaactggaaaagaaatcctccggcggcggactggtcgccgcctggaagcagaaccccctggtcagcaccggcctggtgctgatcctgatgatcgtcgtccagaccgccatcatgatctacaacttcggcgagggcagcgtgggcgagctgctgctctccctgctgaccaactggctcaacatcctgcgcaacaacgcccccgtgggcatcattgccctgggcatgaccttcgtcatcatctccggcggcattgatctgtccgtcggctccaccctggtggccgtgggcgccatggtcatgatggtggtggacggcagcgccaccggcctgctggccggcatgggcatcaccggcgtgcccgcctacatcatcgccatcgccgtgggcctggtcttcggcgcgctgctgggctggctcaacggcgtgctcatcgcccacggcaagctgccccccttcatcgccaccctgggcaccatgcagatcttccgctccgtcacccagcacctgacccagcacgccaacccctccgtgcccaagggctttctccagatcgccaacctgaaaatcggcagcttctacatcatgcccatcctctactggctggccatcgccgccgtcctctatgtggtgtccaagcgcaccaccttcggccgccacgtgttcgccgtgggctccaacatccgcaccgcccgcctgtccggcatcaacgtcaacaaggtcaagcgccgcatctatatgctcaccggtatgctggtggccatcgccgccatcatccaggtctcccgcatcggctccatggactacgccagcgccggcagcggctatgagatggacgccatcgccgccgtcatcgtgggcggcaccagcatgtccggcggcaagggctccatcgtgggtaccgtactgggcatgctcatcatcggcgtaatgaacaacctgctgaccctcttcggcgtgccccccttcctgcgggaggcctgcaagggcgtcatcgtgatcgtcgccgtgctgctccagaagaaggaagccgacgcgtaagagaaaggagcatcccacattatgttcaatatcggcatcatcggctgcggcaagattgcccaggtgcgccacatccccgagtacgccgcccacccccaggcccggctggccgggtactacgacctcaaccaggagcgggcccaggccctggccgcccagtggggcggccaggcctaccccacctgggaggcgctgctggccgacccggccatcgacgcggtgagcatttgcgcggccaacaccgcccacgcggagctgaccatcgccgccctgagggcgggcaagcatgtgctctgcgagaagcccatggccaccaccttggccgactgcgaggccatggccgccgccgcccgggagagcggcaggttcctcatgatcggccagaaccagcgcctgacaaaggcccaccagaaggcccgccagttggtggcggacggggtgctgggggacattctcaccttccgcaccaccttcggccacggcggccccgagacctggagcgtggatccgggcaagaacacctggttcttcgacaagagtaaggccgccatgggcgccatggccgacctgggcatccacaagactgacctcatccagtacctgctgggccagaccgtggtggaggccaccgccaaggtgaccaccctggacaagcggggggccgacgggcagctcatcggcgtggacgacaacgccatctgcatctaccgcatgagcggcggcgccatcggcaccatgaccgccagctggacctactacggcgcggaggacaactccaccgtgctctacggcacaaagggcatcctgcgcatctacgacgacccggcctactccctcaagctcatcaccgccggcggggagaaggcgctctacgagctggaggccatccagaccaacgacaaccagaccgcctccggcgtcatcgactgcttcatggactgcctgaccggcaacacgccccccgccatctccggagagtcggtgctcaccgccatgcgggccgtgtttgcctgtctggagtcctcccggacaggcagggcggtgtccgtcgcccaggattaacgaaaggagttttcacaatatgaaacttggttttgtcagcgccatcctggacggctggagctttgaggagatgatcgacaccgcccgcgacctgggcttctcctgcgtggaggcggcctgctggccctccggcaaggccgagcgccgctacgccggggtgagccacatcgacgtggacggcctcaccgacgagaaggccgcctatatcctgggctactgcaaggagcggggcgtggagctctcctccctggccttttaccccaacaccatggacgaggatctggagaagcgggcggccaatatcgcccacctgaaaaaggtcatcctggccagcgagaagctgggcgtgggcatggtcaccaccttcgtgggccgggccacccacaagaccgtggaggaaaacctggagctgttccgggagatctggccccccatcgtcgcctttgccgaggaacaccacgtcaaggtggccatcgagaactgccccatgtggttcgacgccaccaactggcccggcggccagaacctcttcaccacccccgacatctggcgcaggtgctttgaaatcctccccagccccaacttcggcatcaactacgatcccagccacttcatctggcagcagatggactacatccgccccctgtacgagttcaaggaccgcatcttccacgtccactacaaggacatcaagctctaccccgagaagctggcccgggtgggcgtcatggcctacccccttcagtatatggagcccaagctgcccggcctgggcgacgtgagctgggccaagtacgtctccgccctcaccgacatcggctatagcggatacacctgcatcgaggtggaggaccgtgccttcgagggcagccgggaacgcatcctggactccctgcgcctgtccaagcgctatctggagcagtacgtcatctaacgccagcgggggccgccttcggcggccccccttctgaaaggaaggatattatgggacgcatcatcgcggtcaactccaactgctaccacggctattccattgagcaggccatcgacggcatcgctgccgccgggttccgctacatcgagctcaccgccaccaagggctggacggagcatgtgttccccgaccagagcttcgagcggctgtggcaggtgaaggagcggctggccgaaaagggcctcacccccttctccatgagcggccactgcaacctgatggacaccgggcgcatccacgactttatcagcaacatccgcctggccgccttcttcggctgcggctacatcgtctcctccatcggcgaggcccatctctcggatcaggccgtggcctccaacgaggtggtggcggagcacatccgtgccctggtgcccgagctggagaagtacggcctcaccctggtgctggagacccacggcgaccacgggagcggcaggatcctgaaggagatcgtggatcgggtgggctccccccgggtgggcatcaactacgacaccgccaacgccctcttctacggcaacgtggacttgggggcggatctggacgccagcatggacgccatccgctacatgcacctcaaggacaagggcggcgagcggacggtatgggacttccccgccctgggcaagggctggctggacttccccctggtcttcgacaagctggcaaaggcgggcaacgactgccccttcagcattgaaatcgagtttacccaggccggagcaaaggatctggccgagatcaaccaggccgtgaaggactcggcggagtacctcacagcccacggcttcgtcctgtgaggtggcggccatgatcaacatcggaatcgtgggcgcgggcggcatgggcaccgtgcaccacagcaactatctccacctggacggctgcgccgtgacgggcgtggtagacccctcccccgccgggcgggagcgggccgcccagtggggcgtgccctgctatgagagcattaccgacctggtggaggccggcggcgtggatgtggtggacatctgcacccccaccttcctccaccgggacaacgtgatggagagcctctccctgggcaagaccaccatcgtggaaaagccctgcgccctcacccgggcggatgccgaggccatgttcgccttggcggaggagaagggggtgaacctctatgtggcccaggtgctccagttcacccgggaggtggaggtgctgcggaagctggtgcgggagggcacctacggcaggcccctggacgcggtgttccagcggctgtccgcccgtccggagtgggcccagggcggctggctctttgacaagagcaagagcgggctggtccccttcgatctgcacatccacgatctggacgtgatcgtctccctcttcggcgtccccgaccaggcggagtgccgcccctgcggcggcccggccatggactccccggagctgtaccgctgggagtaccgctgcggcggggtcaacgtcatggccgaggcgggctggctcaacgcctccatccccttcaccgccgtctggcgggtgtattttgagaacgccatggtgatttatgacggcaataccgtcaccgcctacccccacggctcggagccggtggtcttcgacacggaggaggccgtcaaaatccccaccggcatcaacgtcccccccaccggctggtactacgccgagctggggcacttcctgtcctgcattcgggagggaaagccctcccctctggtgccccgggagcgcatcctggcggtgctggatctgctggagaccgccctggaggcggacggatcgaactgaaaaacgctccccgcgcggctggcgcgcggggagcgttttatcttttctttattcgtgtttgctccgggctcagccgatcgcggccttctgtcccggatgatcggttcccatggtggatttgaggttgtagcgcacatcctccatgtgctcctccatgcactggcgcgccccctccgcgtccccctcgatgaccttgctgaacagggcctcgtgggccacaatagagctgtacgagatgccgctgttgttgatggtgaactgccgggagatgtccagcagctcatagaggtactcgtatacgctggagagcacggcgttgtgggcggccctgaccagggcctggtggaagccgtgggagagcttgcgcaggttctgcaccgactcctcggtgccgtcgttgaccttcttggcctcccgcatgtcccggagcagcttctggatggaggcgatatcctcgtcggtgcgccgctgggcggcgtgataggccgcgaaggtctccagcacgatacgcagctccagcagatcccggatggtgtccgccgtggcgtcgaaggaaaaatccatcttgctgaccaggctctgcgcggaggtgttcttcacataggtgccgtcgccggggctgctgtccagcacccccatatactccaggatcttgagcgcctcacggatggggacacggctgacgttgaacttctcggccagctcccgctcggagggcagcttctggcccgcctgaagctctccatcggcaatcatctggcggatgttgtcaatcacgtactcgtagaagcggccgctgccgtccgcctgcttggttgggagattcatcggactcctccttttatcctcaagtactttttccttattttatcataatctgaggtcaaatagaagggatctctcaaaaaatcccccagccggagtcaaagacggatgatgccatgcttggccttgctctgggcgtaggcctgctccacatactcccgcagcccgggacggaacttggggtgggcgcagttctcaatcaggacatgggcccgctcgtaggccgtcaggccccgcagatccgccaggccctgctcggtgacgatgatctcggtgtcgtgctccgtgtgatccacgtgggccacgtggggcacaatgcaggagatggcgccgtccttggcggtggaggcggtggagaaaatggcgatgcccgagttgcgggcgtagtcgccggagccgccgatgccgttcatgacggccccctcgccgatgtgggtggagttgacgttgcccgccagatccacctcaatggcggtgttcatggcgatgatgctcaggcggcggatcacctcgggggcgttgctgagctcctggggccggaggatgatcttgcccttgtagtcgtcgatatgggcatagaaccgctcccgggcggagggggagatggtgagggccgtgccgctggcgcaggccaccttgcccgcgtcgatgagctccaccaccgcgtcctgcatgacctcggtatagacgctcaggtgctccagctcggagcgggccagggcggagagcaccgcgttggccacgccgcccacaccggactgcatggggggcagagggttaggcaggcggccggccgccacctcgctctgtaggaatttgacaatatggctggcaatggcctccatatccggggtgggggcagggagatcctggttggtgtcctcgcagttggtgaggatgaccgcggcgaccttgtccgggtcgcaggccagataaggggagcccacccggtcgtcgggcttgaagatctcaatggcctgggtgtggggcgcccgctccagggtcaggatgtcgtgcatgccctccacctccagggggatggcctcgttgacctccaggatgagcttgtcggcatacttcaccagggtatcgtcaatgcccaccgagaaggggagcaccagactgccgtcggcccggatggcggccacctcgatgacggccacgtcgatcttccccaggtagccgtttttgatcaggtaggggccgtggctcacatgggtgtccacatattgaatccggtcggcgttggccagggcgcggagatcccggttgccctgaaagccataccgccgcttcatcacgccggagcgggccagcactccgtccagctggtcgcccacgttgcccccggtgattacggtgatgcccagctcctcgccctcctcggcgcgccgggccagctcggccggaagcaccttgggatagccgatgaccgtaaagccgctgaagcccacggtcatgccgtttttgatatgcgccgccgccgccctgggagtggtcaccttgcgcagcagcgcctcgttgcaaatgcggtccattcggaataccgatcctttcttttttctctaattggtataccattttgaggaaaaaaagcccggcggagccttgcggttccccgccgggcctcaaacgagggctcttgttcagtccgccagctccagaagcgtggcgccgccctggccgccgcccatgcacagggtggcaatgccgtaccgggtgcgggtgcgcttcatgccgtgaaccagggtggtcaggatgcgcccgcctgtggcgcccagggggtgccccatggcgatagcgccgccgctgacgtttaccttcgccatgtccagccccagctcgcggatcaccgccagggactgggccgcgaaggcctcgttcagctcgatcatgccgatatcgtccagtgtgagccccgccttctccagcaccttgcggacggcgggcaccgggccgatgcccatgatgcggggatccacgcccacgatggcgtgggccacgatgcgggccatgggcttgacgcccagctccttcaccttctcgccgctcatcagcagcagggcggcgcccgcgtcgctgcgcccgcatgagttgcccgcagtgaccttgcccttgccgttggtgcggaacacgggcttgagcttggccaggccctccatggtggtggccctgggctgctcgtcggtgtcaaacacgatgggctcctttttccgctgggggatcaccacggggacaatctcatccttgaacacgccggcggcgaccgcctcggcggccttgcgctggctgtggaaggcgaactcgtccatgtcctcccgcgagatgtggaactgctcggccacgttctcggcggtatcgcccattccgaacacgccgtaggtctcctggggctgggcccgcttagccccctccacgatgggatccaccagcacgttgttgccggtgccgtagccgtaccgggcgttccacagctcgaagtgggtggcgctcatggcctccacaccgccggccaccgccacgtctacgtcgccgcagcggatgtcgttggccgcgcagttgaccgactggagggaggagccgcactgcatcatcagcgtataggccggaatctcctcccggaagcccgccatcagggcgcacacccgggcgatgttggaggccacggcgttctgcttcacctgggcgatgacgacctcctccaccagctcgggggccaggccggtgcgctccatcagggccttgcacaccagcccccccatctcgtgggcctgggtgttcttcagcgtgccgcccatgcggcccacgggagtgcggacggcgtctacaatataaacctcgcgcataaaagcgtcctcctttttatgttcaggcccgtgcaatgccctgctctctggcctcctgtgcgacggcatgggccacggtgtcggccacggacttgtccagggcggagggcaggatgtagtcggcgctgagctgctcgtcggtcaccagggcggccagggctctggccgcgcggattttcatcccctcggtgatctcccgggcccgcacggccagcgtgcccttgaagatgccggggaagaccatgacgttgttgatctggttgggaaaatcgctgcgcccggtgcccaccaccgccgcgccgccccgcttcgcctcgtccggcatgatctccggggtggggttggccatggcgaacacgataccgtccttcatggtggacaccatctccgccgtcaccaggttgggccgggacacgcccacgaaggcgtccgccccccgcagggcgtcggccagagcgccgtgctcgtgattccggttggagatgtgggagatctcctcctgtccggcgttgagcccctcatccccctcgcagatgatgccgttgatgtcgcacatgacgatattgccgaagcccatggagatgagcagcttgccgatggcgatgccggcggcgccggccccgttgatgacgatcttcatctgccccatctgcttgccggtcacccgcatggcgttgagcagggcggcggccaccacgatggcggtgccgtgctggtcgtcgtggaacacggggatgtcgcacacctccttcaggcggcgctccacctcgaagcagcggggggcggcgatgtcctccaggttgatgccgccgaagctcttggagatcagggcgatggtctccaccagcttgtccacgtccttggtgtccacacagatggggaaggcgtccaccccgccgaactccttgaagagggcgcacttgccctccatcaccggcataccggcggccgggccgatgtcccccaggcccagcaccgcggagccgtcggtgatcaccgccaccaaattgccccggcgggtgagggtaaaggacttctcatagtccttggcgatctcccggcagggctcggccacgccgggggtgtacaggagggacaggtcgtcccgggtctcgatgtgcctgcgggccaccacttcgatcttcccccgcagttcctcgtgcagcttgagggattcctgattgacgtccatagtacgtttttcttcctttctgcggcccgctcagaccatctcttcggggtggaacacctcgtcgaaccgctcggcggtgaggaagcccaggctgacgcaggcctccttgagagagatgtactcggcgtgggccttcttggcggtcttggccgcgttgtcatagccaatgtaggggttgagggcggtgaccagcatgagggagttgtgcaggttgtggcggcacttctcccggttggccgtgatgcccacggcgcagtggtccttaaaggagcggatgcagtcggtgagcagccgcgcggactggaggaagttgtagatgcacaccggcatgaacacgttcagctcgaagttgccctgggaggccgccaggcccaccgccacgtcgttggccatcacctgtaccgccaccatggtcaccgcctcgcactgggtggggttgaccttgccgggcatgatggaggagccgggctcgttctccgggatctggatctcccccaggccgcaccgggggccggaggccagccagcgcacgtcgttggcgattttcatcagatccgccgccagggccttgagcgccccgtgggcgaacaccagctcgtccttgctggtgagggcgtggaacttgttgggggccgtgacaaaggccttgcccgtcagctccgataccgcctcggccacggccgtgtcaaagcccgcgggggcgttgagcccggtgcccacggcggtcccgcccagggccagctcccgcaggccgggcagcgccagctccaccatcgccctgtccttctccaggctggtccgccagccgctgatctcctgggccagggtaatgggcaccgcgtcctgcaggtgggtccgcccgctcttcaccacgtccccgttctccccctccagccggcggaaggtctccaccagcccgtcaatggccggcagcagcttgtcctccagcgccaccgccgccgcaatgtgcatggccgtggggaaggtgtcgttggagctctgggacatgtttacgtggtcgttggggtggagcagcttcttccccgccagctcgttgccccggttggccaccacctcgttcacgttcatgttggactgggtgccgctgcccgtctgccacaccaccagcgggaagtgcccgtccagcttccccgccaccacctcgtcgcaggcccggctgatcaggcccagcctttcatcgtccagcttccccagcctgtggttggccagcgccgccgccttcttcagaatcccgaaggcccgcacaatctcctccggcatcttctccgtgccgatctggaagttctgatagctccgctgggtctgcgcaccccagtagcggtccgcagggacctccatctcccccattgagtcccgttccatccggtagtccatcctgtctcgcgtctcctttcgtccgccctcaggcgggataggcctcgtcgatcttgtgcagcgcggcctctttcagatttttgtagatgctctgcccgtgggtgtccatgcccaccaccagggggccgaactcattggcctggaggtcccacacggcctctggcatgcccagctcaaaccaagtcacatcgttaatgcgctcaatgccctgggccagcttggccgcgcagccgggggccgcctggaggtacacgtatccgtactggccgcaggcccgcagggtatcggcgtccatgccgccctttccgatgaccgcccgtacccccatccggcccactacatcggcatagggctccatacggatggaggtggtggggccgatgacgttgagccgccaggagccgtcctcgtttttcagggccaccgggccggcgtggaacaccgcagcgccggcaaagtccttgggcaggggcttcccctcctccagcaggccgcggatacgcaggtgggccatgtcacgggccgtaaatacatgcccggtcagatacaccacgtctcccacgtgcagcttgcgcatgtcctcttcctggagaggtgtggaaaaatgataagtagccatccttactatactccttttttgccgttttggaaatcagagcagcttctcaacgcggccgtcgtcgtagatgcggataccggcccggcgggccacccagcagtggaagttgatcgccaccggcgcgatggcggtgtgggtgtgggcccgctccatcttgagggccaggcagacggtgtcgccgccggtacccgccgcgcccaggcccaggccgttgatggcgtccttcagctccgcctccagcgcggccagctcggggtcggggttcacgtcgtcccaccggcgggtggagatggccttgcggctgagcttggcggcaatgtccatctggccgccgatgccgatgccgatgccgtagggggggcagggcttgccgccggcgttgacggcggtctccaggatgaagcgcttcaggccggagaggtttttgcccagcttggcggtggtcataatctgcatggcgttgcccagctcggcgccgcagcccttaaagctgatgatgaagtcgacgtatttctggccggggtggtattcatactcgatattgggcacgcccttgccggtgttgtttcccgagttctcccgggtcagggggtccaccatggaggggcgcaggtagcccttcttcgtggcctcggccacggcctccgagatggcctccctggtgcactccggcaggttgccgtctccaaaggagagccaggttgtggggtagccgggagactggcacaccgccttgtccccctccttggcgatggacaggttgtccaccatggagcggagcatgctctgggcggtttcattcgtttcccgggccagtgcgtctttaagcagccccttcacatcggcggagatttcggtcacggcgcggataaccgcgtcatgaatggcggatttgacaagtgcttcgttctgattcatagcgcaatgctccattcgtaaggtaatgggcgccgccgttccggcggccgcccgctgaggcagggcttacagcccctcaaacagccggtttatgtcatccagctcctccaggtgcggcagccgctcaaccagcgcggcaacccggtccgggcccagaaccccgtcggccagggtgtgaaacttctcgtgctcataggcccaggtaaaggggttattgaagtcgccataggggtactccacctgacgggtgagcacccggccgtcctccagagttacctccaaccggtgggcccaccggttgcggtccgcctgatagctggcctccagctccgggtcgcacaccagggtaatcttgtccatcagccgccgcacccgtgggtcggaggtggcctccggcgtgaaggcggactcccccaggtggccgtacaccagcatggccgcggtgcagtactggccgctgaatttgtagccgtagggggtggatggctccggattgtccaccgtgttgaccgccacctgataggtgtgatccacaatgcgggtgatgtgctccggctccagccggtgctccccccgcagcagttgggcgcagtagtccgccgcgtgggtgtggcgacagcaggcgtagggcttcagggagttggtcagcagggcgcagttgtcccagctcaacgcccgcgtcagcgcctccgggtggttatccggcgtcatggcgcccagcaggccccggtctcccgccagaatgtcctccgcagcggtaaagcccagcgccgccaggcgtgccgaccgcaggccgcagagggtaccgttggcggtgtgcagggtcttgctcatggcgccgtcctccagaaactgccacaggccggccgcctgcgtccccgccgagccaatggcgtgcagcagtttctcccggtccagccccatcagcttgcccgccgccacggcagagcagagcgcccccaccactccagtggtatgccagtagtggtaggagcctgggttgatggcctcccccacccgtgcgccaatctcgtagcccgcggcaatggcagccagcacctcacgcccggagcggtgaagcttctgccccaccgccagcgccgcggggatggttaccgcccccaggtgggtgatagaggcgttgtgcacgtcgtccatatccatgacatgggcgcacgcggcgttcagcgcggcagcatgttcgcaggagagccgctccagtccgctgttccaggcggtcgcctcctgctgtccgtccccggcggcaaagtagctgcgccagatacccccctgcggctgaactgagccggctgccgccacgccgagcagatcctccagatagagctttgcgttgtccaccgctttggagggcagactctcatagcggacttcatatagaaaatcggaaagctgttttgtaagcattcggacctcttcctggctgtcccattggtccagccaaaacgtgcgccttttgggaataccgcaccatgtcattccggtattccgcgcaatagcaggcgcacatatttttctttttatgtagtatttttttgctaatattccatttttatctcttttttgctttttctctggtataccaatccgaattatagcagattcactcagcaatgagaatacacaaaataaaaatcgttacatttgacaaaagccgtcgcttttccttggtcataacagagaaatggcaagttgcatctttacaaattgtatgcataagtgcaatattggctccactggtataccgattctccaataaagcacgcaatttaagtcgttttgatggaacggaaagggatatccaattatgaaaacaaacaagcttatgatcacctgcgccctctgcggcggcggtaccacccgcaagcagtccccctacgtccccctgacgccggaggagctggtcgccgattctctggccgcagttcgggccggcgcctgcatcctgcacatccatgtccgcgatgacgagggcgcgaacaccatggagaccagccgctttgtgcaggtggtctccatgatccgggaagccctgcgcaccaaccacctggatgccatcatcaatgtcaccacctccggcaccaagttctccgaggatatgcgggtggcccacctgcccatcctgatgcccgagatgtgctcctatgaccctggtaccctcaactgggccaacagctacatcttcctgaacacgccccccttcctggagcggctgggcctgctcacccaggagctggacatcaagcccgaaattgaaatctttgatgccggtatgctgggcaacgtggattactacctgaaaaaaggcgtcctgaaggccccgctccactaccagctggttctggatgtccctggtggtatgccgggcaatattgactcgatcaaccatctggtttccaagctgccggagggctccacctggtcgatcaccggaatcggcaaggcccacatgccctgtatgctggccggtctggccgccggctgcgacaacctgcgcgtcggtctggaggacaacgtgtttatgaagaagggcgaatacgccaccaacgcccagttggtggagcgggcggtcaagcttggtatcctggccggccgtgagattgccaccgccgccgaggcccgcgagattctcggcatcaagcctgagaagggcgttctttatcagccgtaaattgacttggaaaaggagaatgcgcgatgaaatacgattttgaaacgattattgaccgcgatccggccatccgcggcaccggaaagtaccgcatcatgaaggactccaagggcaataagccccccaagggtatcgttcccctgtcggtggccgacatggagttccgcaccgccccctgcgttattgacgcaatcaaagccgaggcggacttcggcgtgctgggctaccaccgcctgaccgacagctttcgggagtcctgctgccagtggatgaaaacccgtcacgattgggacgttcagcccgactggatcgtccccttcgagcaggtcgttcccgccctctataacgctgtctggacctttacccagcccggcgacggcatcctgatccagacccccgactaccaccacttcaccggcgccaccgtcaataccggccgcaaggtgctggaaaaccgcctggtggccgacgagaagggccactataccgtggatttcgacgacttccgtgagaaggccaagcaggccaagctgttcttcctctgctccccccagaatcctaccggccgcgtctggacggaggaggagctgcgcaggatgggtgagatctgcaacgagtacggagtcatggtggtggccgacgagatccaccacgatctgatccagcccggatacaagcacattgtgtatgcctccctgggcaaagagtttgccgacaactgcgtaatctgcacctccctgagcaagaccttcaacctggctggcctgtgctacgccagcatcatcatccccaacgacgaggtgcgggccaagttccagaagcagatgggcctccaggccttcatgcacatcgagcgcttcggccccgtggcccacgaggccgcctaccgccacggcgccgggtggctggaagagctcatccaggtcatcaagggcaactacgagtatgtccgcgacttcttcgcccagcacttccccggagttgtggtcaccgagctggagggcacctacctggtctggtgcgacttccgctgcttcggcatgagcgacgcagacatgaaggtgttcctcaccgacgagtgcatgctctacctggacaacggcaccgacttcggcgcggccggttccggctaccagcgcatcaacgtcgcctgcccccgcaagaccctggcagacgctctggaccgcttctatcaggccgccaggaagcgcggcatggcccggtaatttccccggaaacacgaccagaatggattaggaggctatgacatgttagagaaaaaggtaccgttttgtatcgaccacttcagcatcgccactacccaccgcgaccgcccgatcgacctggtgaccaagctgggctttaccaccgccgactgctacaccgaccgcaccgtgcacttcatctttgagaactcctacttcgagctgtgcacctatcagttgaacaccaccatcacttggctgacccagtccgtccccgccaccaatctgcccaaggttcactcctatcgcctgagcgtcaaggggactgaccccaatcccatgcgcaacgctttgatcgagggcggcattgagaccatcggcgagatcaacaaccccttccgccagcatgtccgctacggtgagaaggagggcgaggccggttaccagaccttctttattcagaactacgagccctttaccgacattctcttcggctgcaccacccatctggccaaggagctgatcgtcaagaacgagaccaaattcccccacatcaacggcgccaagcgcctggcctacatcaccggctactgcgacagcaaggagcgctttgaggaggccgacgccgccatctccaagctctacaacgccgccaagggggccactgacaccggcttcaacctggacacctatcagctggtggatcacgacgcctacgtggccgagttcggctgcgagccccgcaacgacggcctgaagctgcccatcgtggccgccgccttctccggctgccacctggaatttgtggaaaagcgcgcctatgatctgaacctgaattacttccacaaggacggcaagctctatgtggactgccgccgtacactgggtctgttcctcgtgttcatgccctaactacctcatgtgcccatatggggaaggagtctaaaatgtctattcccgatctcgaaacctatttacccaaggtcatttcttggcgcagggatctccatatgcacccagagctaggactccaagaagtccgtacctctaacttgattgcagatctcctaacaaagttcggccttgatgtgcagcgtaattttgctggtacagcggttttgggaacactacataccaataaacctggcaaaacagttgtcctgcgcgcagatatggacgcacttccaatccaagatgccaaagatgtaccctaccgctcacaaatttcaggtgtctgtcatgcctgcggccatgatgcccatactgcaaatcttcttggtgttgcgaactatatttccgatcatcgtactgaattttgtggaacaataaagttcttgtttcagcctgcggaagaactgttagaaggggcaaagcttgtctgtcaatcaggtgtgctggatggcacggattacattctgggtcagcatgcagtactggatgtagatgtcggtcaagttcaggtatgctacggcccttcaaacggtggtggtgatgaatttactttacggctccatggtgtaggttgccatggtgcacgtccgcacaccggtaaagatcctattttactcgctgcaaaagttatcgagggatttcaacaaattattagccgtgagctggatccattaaaggccgctgtcatttctgtttgttcggttcaggccggacagcatgaatcaaaaaatgtcgttccgcaggaggctgtgttagctggaaccgtgcgcacgctggaagaggatgtacgcacctatgttttgactcggatggaggaaatcgtagctggcctgtgttctgcaagtcgttgttcctataccttggagcatgttacaaaagtgcctcccttgaccagcgaccagcagttgacccaattagttgagaacaccgcagtggaattggttggacgtgaaaacgtcctataccgccctgctcccacaatgggggttgaggacttttcctggtataccaggaattataatgcgtgtatgttctactttggcgccagaaatgtcgaaaaaggaattattacgcgggggcataatccaaagtttgatattgatgaagaatgtttcagggttgctatgccaatgcttattctgctttcaaaacggctgatgctggactagttatcgcatttcctactaattgacagagagaggggaattgttttggagcttgagtatttgaaagtcgcaaataaccctattatgtggatttccgtccttccaggcgtattgttagtaatcgtgcaggcgattgtattatctcgaagagccattgtatccggaagaaaaatgggtattacagagcgtcagtttaaaagcgcgattcggagttccgctctggcctcaatcggtccatccctaatcattgtaactggaatgattgctttactcagctccatgggaggccctattgcctggatgcgattagcctatattggcgctgtcaactttgagctttctgccgctgatcgggccgcctctgctgtcggatgtaccttgggaacctctaacatgactatggaagcatttgcctgcgccgtatataccatggtaatctgctgccttggctggattcttgtttctgccctttttgcacacaaaatgggtgacttgcgtgaccgggtagctggcaacaacaaagcaaaaatgagtgtcatcagtgtcgctggcggtatgggcgcttatggctatcagtgctttaatcgcggcattgttctcgccggccccgatgcacaaacaatgacggttatttttggttttggtattatgtttgccttggcaatctatggtaaaaagaaaaacgtggcatgggttagaaaatttggaatgatgatcgccatgtttagcggtatgctgcttggatcctttttcttgtaaggttaatacttccatcgcttgaaaggggtatttctatgacagaaaataaaccaaacacttcctcgatttttcacacagacttcttgccctttgccatccgctgggggcgtggtttaagtctttttggaatcgttttagcctttggtccatgccttggattggccgttatgggtattttcccatctgttagcggtgtaatggctggtatcgccgctcagctccccgcagtagtcgctgcatatttctatgaaccaatctcctactttgccatactgggtattgcaggcacttatatgggctttctttcgggaaatgtaaataacatgagagctccctgtgcatccatcgctcagagcgctgctaacgtcgaagaaggtagtgacgaaggcggtatcatagccactgttggtattgctgtctccatttttatcaatattgccttcctgacagtcggtgttattgtaggcaactatgttgttagtctgttgcctcagcatgttttggatgcgttaaatctattgctcccggctctgtttggcgcactctttgcaaatcaaattgtaaaaaagccaaagttagcgcttgtcgccctcccgattacgggtatcatggtcctaatgaataagcttcagctcctttccttcctccctggcaagctggttactcccatcgttatgcttacctgcgtcttcggtacaatgggaatcggactatttctcgccagtaaaggtaaaatggattaattgttatataaaatacagaaagcgaggatcaatcacacatgaagtccgccttaaaaaaggtgtcgctgatcctggccatctgctttgtagcatttcacctctacaccgcagcgttcggcactatgccgggcattgcgcagaagtcgatccacctgggcttcctgctggtgatcttctacatcaatgcaatggtcgacagcgagaagcgttgggagcaaatttttctcggtattatggcactcttcgccctgggcggctgtgcctacatcaccatcctggatgaaaacctgcaactgcgcgccggaattgtgtacgccagcgacattctgtttgccattcttctgattatcgctatctttgaggcgtgccgccggaagatgggcaatcccctggtcatcatcaccctggtctttgtggcctacgccttcctgggcaagtatattcccggcttcctcaaccagcccggcatgacgctgaagaagttcacctctttggtctatctgaccacagacggtatcttcggctcccccctctatgcctcggcctcctatgtggtcctgttcgtcctgctgggcgctatcatgagcgtctccggcatcggcgactatatgaccaatctggccacctccctgttcggccacatgcgcggcggccccgccaaggtggctgtggtggcctccggcttctttggctccatcagcggcagtcccacggccaatgtcatcggcaccggcactttcaccattcctatgatgaaaaagaacggctttgagcccgagtttgccgcggcggttgaggccaccgcctccaccggcggagccatcatgccccccatcatgggctccaccgcctttattatggcggaaatgctgggcattccctataccgccgtggcaaaggccgccctgatccctgctattctctacttcctggccgtcctctttggcgtggatatctatgccgccaagcatgggctgaagggcattccccgctcccaactgcccaaggtacgcagcatgctcaagcagatttacatgcttgcccccctgatcttcctgatcttctgcatggccgtgttcaatatgaccatcgtgcgctctggcctgctgaccatcatcgtcactctcgtcctggtggaaatcaaccccaagacccgtatgaccaaggagcagtggctccagattcctgtccagacggtaaagagcgccgtttccgtcggcattgcctgcgccatggccggtattatcagcggtgtgatcatgggcagcggcctgggctaccgcatctcctccatcctgaccagcgtggccggcaccagcatgctgctgctgctcgttctgacgatggttgtctccctgatcatgggcatgggcgtcccaaccacggcggcctatctggttctggcctccctggtagcccccacgatgattcagttgggcattcccccgctggccgcccacatgttcatcttctacttcggctgcatctcctccatcaccccccctgtggcgctggccgcctatgccggcgccggcctggccgggtgcgatccaaacaagacaggctacaaggcgttccgtctggccttctgttccttcctcatgccgtacttgtttgtctacaatccggtactgctgatggagggcggcgtgctggacatcctctggagcctggttaccgcgctcatcggcgcctatctgctggcctccggcttcgagggcttcttcttccgctggagcctgaagtggttcgagcgtccgctcatgatactgggcgctgtgatgctgattgtgcccggtatggtcaccgatttggtaggtatcgccatcatcgtggtggagtttgtcaccgagttcatgtttaagcgttcggagaagttcgtccccgttaccgtttcccagtctaccacgtgacattttcccccgggtgaatgccattggagagaaaaagaaaaggagatatcgttatgaaaaagctgtcaaaacttatgtgtctgttgctggcagtcggtatgctgatgggaatcgcctcctgtagcagtgatgctggagaggggggcggaggctcctccggcggtacggaaaccgtgcgcatcagctgcgggcccctgaacggctatcagaacgtcctgtataattccattgccgacatgatgaacaaagccaaccccggcaagtacagctttgccattgaggcctccaccggctccgccgagaatgcccgcctgctggctatgggcgaaaccgacttcggcaccatgggcatggatatgaccctgtcctgctacaatgccgagggcgagtttgagggcctgcccgcagagcagatcatgcacgtggccacccactccggcaccggcgcgacggtccacgttatcacttctgcgaagtccgatatcaatagcattcccgacctggccggcaccaaattcggtgtcactgccggcatgatggccggttacctggacgatgttctgtgggcctacgatatgaccaccgatgatctgggcagcgtggtaaacctgtccctgtccgacctgtgcaccgccctccaggacggcaatattgacgccttcctgtacgccactcccgcccccggcaccaactttaccgacctggccatgtcctttggcatcaaggtcgtcgacatcggccaggaggccgttgacaagctgatggccgagaagccctggtaccacacagtggttatccccgccggcacctatgacggctgtgatgaggatatcaccacctttgcccagtacaccgctctctgcgcccgtgccgacgtgcccgaggagaccgtctacaacctggtcaagaccatgatggagaacgccgatgctctggaagccgtgcataagaacgccgccggcacctgtccggagcgcggcatcgaaggcgccctgatccccatgcaccccggcgccgagcgctattacaaagaggtcggcgtgctggactgatccccaattccctttcaaattccctccagattgaagcaagcggtaccgcccatccgggcggtaccgcttgcttttgtcaccgcaggaatcaatagatccccgtcagctcctgatagagattttttgcataggggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctgccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgacctgcataggagtcagtcataccgctgatgaagtcggtcaccagcagcagccgcagatagaggcggtacccctcatcctttccctctgcgtcggcccggtagcaggccagttgattttcgaagagcagcttgaccagctttttctccgccgccgtgggccggtattcctcgggggcgtcgtcgccggcatccaggtagagcaccgccgggacaaaccgggacagcagggtggtgagtatggtctgggccgccagctccagggtgagaattccctccgagtcgtaggcaaagcgacccatggccgccttcaaaatacggatggagccgccgtggaaggtgccctccatgatctcccgccggaacgtcccctccatgatggcggaataggagtccgtctgtccggcgccgtaggggacgaagccgaaggcggcggtatacatgagccagtggcgggcataggcgatccaccgctggaaggccgccatggagctgctctcccgctcgcgcaggcgggtcagctcgtcgatcatctcggcggattttttgacctggccgccgttgaggccccagtcgtcctttttcgcctccagggtgtcccggaagaaccgctcgaactcgtccagggtgaacaggcccttcttgtaggcgtcctccagatcggcagtggcataggcgatgtcgtccgccgcctccagaatataggtcaggggatggcggcagaagccctccaccgtccgggtaccggtggcggaggccagcgcgccgaaaagcgcctcctcggccttgtagtagcccagcttgtggagcttcacgtcggcgctggccttgtctacccgggtggaatccaccgggtacttgaccagggtgttaagcacggcaggcatgagatccataccgaaggcgctgtccacccggtacaccttggtcagcaggcgcagggcctgggcgttgccctcgaagtggcagagatcggccttcatctggcggtccagccactgggacaggggcctgcccttgtagctcagacggtccaggtggctcttgaaccagtcgccgatgaccacctcgccgaagtggccgaagggcggattgccgatgtcgtgaagcagtccggcgcacatgacggcgttggccgcgtcccgcgcctcgtcctccgtcatggcgtagggggtgccgctcttgtttttgcggatattggcggtaatcatggtggcaagctgcttggccagcgccgaggtctccatggagtgggtcagccgggtgcgcacaaagtcactcttgtccaggggaaacacctgggtcttgtcctggagacggcggaagggcgcgctgttgacaatccgccagtagtccagctcaaagtcgttcatcgggtatttggacaggtcgtccgggatgtccagcggttccttccgccgggcatacaataggatcttccattccattggttcccctccttttctttttctctatgtggcttcggcaaaatggaacaccattccacaacgttttctttattatagcataaaatccctctgaaaaaacagcggcggcgtgtttgaaaaccttcactttttcaaacacgccgttgtaattacataatataccacagctttccaggaataacaagcgcttttgctagagatatacgctttcttgttgtcaattttagcttttttcgacaagtaattttacggactgaaaaagtgaaattttttaaacatgaggcgcgatatccccaatattcataagagaggagttttaaaaacatgaaaaagcgattgttatccctcattttggctttatgtattataatttctttttctccttcaactctggctgcaaatctaccggaggtagacgtgcggacggaggggcttaccccggcgcagccccaggaggcgcccgcagagaagccgagggacgccggcgcggagcggcggacgatttatgtctcgaacgaaggtacagaggaggacgacggcgcgaccgccgaaacgccgaccacgctggcccgtgcaaccgaattggcaaacgaagggaaaaaaccggtcgaaatcgtggtcttaggacaggtatcagtagatacctggactagccccactgtagagactactcttcgaggcggggacgagaacgcggagctgctgtttgagtattgttcggcctcggatggagcgtacaacatcagtctggcagatgccctgaccatagatgacatcaaatttaactgcaactatacggattatttttttagcagatattatggtacctataccatcgttgccaacggttatccgttggtcatcgcctcgggcgtgcagtgcagctattataccgcagacaccattgttgacggtaaaacatgtagcacatccagctgctatgtgattggcggaggtctggacgaggatatcaccggcggcactcatgtggagatttatacctccttgccgcttacctatgtatacggcggcggagtgaatggctccgtggagagcaatgtttatctgcacattgaaaactgcggtaagattcagcatgtgcgcgctggtggttacgcaaataaaaaagatgccaaagtcaacggaaatataacgttggactttatcaactcagtcaccgataatcctatctatggcggcggatatgcgcggtcgtcctattcagcggaggttactggttcaatttgcataaatctgtccggactaaataatggctttggcaggcccatttacggcggcgggtatgggaaaaacgctccagtagtaggaaatattagatttaacatttcgaatactaaaatgaacaataatgcggccgctatctatggcggcgggtacaacagcgacgtaacaggagacatctttatccatatcaaagaaaacagccttatctcagaggaaaccgtctggggcggcggaaccggagattccaccataacaggtggtgttacaatcaccgtggatgacagcagtgaggtgatcggtgagatccgcgctggaggcaatgaaggcgcggacgtgatcggcgatgtcgtaatcacagtatccggtggcccccaatccgcctgcccgaccatttttgcgaccggtaaaggggaggacaaggataacccggcccaagttgacggcaatgtctccattactctgcacggcagccgggccaacgtatacacactggacaagtttggcgaagtgacctccgaccatgcggttacgattatcctggacgacactgacgagctaagcggcgcagttcggggtgattccaagctgggccagcacctttataactatgagaaaaacacccccacccgtacaggaaacggcgccagcgtcatcgtcaaaggcgattacacctctaccggaatccacgggttccctgaggttgtaattgaggacggcggcatcctgcgcgagcatctcgcctccggcgagacgctgtttgacggcgtggagactgtcaccattcaagagggcggcgcgctggatctgctgcaaagcaacgagatttccggaaacttcacttgtgcaggcacattgaaaatgcctgcgccgatcagcgcagaagcagatatctgctatttgacggcgggcggcaatgtcaccgtgcaggagggcgcggcctatgtccccactaaggataacggcgcggccgatgcggactacgtcaagggcgatgtgttcctcaagcagggaacagtatacacagagccgtctgcaaaggttgactttgccgtctccgaggccggtcaggccaaggaatacttcacggatgaccgagcggtaacagacgagtccgacatcacccacgagtggtttgtcgaccagacccagtatgtcaccatccgcccggcggacattacggtttacaccggcggcaacagctatgacggcgtcacggacgagaacggccagattgtcagcggcagcggcctgcctgaggcaggctatctgctcaccgtcccggaggagattaacgatatgctggaaggccctggacaggcggttgacctcgccggtcacctgacctttacctatggcgccggcgaaaccgtccgggcctgggatattcagctttacagcggcggcgctaccagcaccaccgacccggtggacggaatcgcccgttatatctaccggatggaatcggtaaaggaaggccaggatcccgttcggctccagtttacggatccagagaccggggaagtcaagatcagcgacgaattcgaagtctctgccatcgagcagaacaggacctactccatgaccatctactccggcggggtggatcaggacctcgtaaaggcggtgttcaaagatattcccgaacattccgacgagacatttacctacccggtcaagattgaagaaggcgccctcaccattcgcggtgcgacaaaggagggcgtcactgccccggtggaggacaaggcagacgatgtgacgggggacgccatcaccgcggtggccccggcggacgttacgtactacgtcaacgacagccaggtggagatcaccgacaagaacgccgtccacctgctgaccgacgaagtgctggacgaccaggtgctcattgatcacatcagcaatgaaatcatcgggtctgataccggcatccccaacggcgactatctctacgagttccaatacctggatctggtggacagcagcaacggcaacgcctatgtgaccctgggcgacggccagacgatagatctctactggccggtgcccgacgacgccgacacctctgcgcccttctatatcgtccactttgacgcgctcgaccgcgactacgagggcgcggcggacgaacaactgaaggagaatcctgcggagaagctggacggcacactggtaaccctgaacggcaaacagtatatcaagtttgccaccggcagcttctcccccttcgcgctggtctatcagaaggagtccggcggcggggaccacggcggcggtggtggcaccacctactacaccctgcgctatgagagcaatggcggcaccaaatacaaggacgagcggtaccgacgcaatactctggtggagctggacaaggagcccgtccgggagggctacaccttcaccggctggtacgccgacaaggccctgaccgagcccatcgacgacatccgcatgacctccaacaagaccgtgtacgccggctgggaaaggaccggcgtgcccgaccggctcaatggagacgaccatttcgcctacatcatcggccgggacgacggcttggttcaccctgaggcccccattacccgcgccgaggtggccatcatcttcttccgtctgctcaccgacgaggcccgggacgagtacctgaccgagaccagtccctttgccgacgtggcctccgacgcgtggtacgccaccgccgtggccaccatgcaggccatgggcatcgtggagggccgcagcccctccgccttcgatcccgaggcgcccatcacccggggcgagttcgctgccatcgccgcccgctttgacagcgatccctaccacggcgacgaccgcttctccgacatctccggccactgggccgccgggtacatcaaccaggccgcggtgaagggctgggtggagggccagcctgacggttccttcgcccccgaccgcagcatcacccgcgccgaggccatgaccaccatcaaccgcgtcctgggccgcctccccgagaccgcggatgatctgctggacgacatgatcgcctggcccgacaacccgccggatgcctggtactatctggcggtccaggaggccaccaacagccacgactacgagcgcaaggccgacactgtccacgaaacctggaccggcctccagcctgcgggaaactgggctcagtaccaataaccttcacaaaaagaacggccccggaacccgtcggttccggggccgctcagcctgtcgaaaaagtcttttcgacaggctgagggactttttgaaaccttttgaagtttcaaaaagtcggttgaccaaacgcaaaagacaaccctgacggttttctttcacactatctttccctccgaaaccttcacccggaaggtttaccgatagcctcagcggccccggaacccgtcggttccggggccactctctgtttccacatacggacgggccgtcacaggcggtagatgcggtgaaactcctcctccagccaatcccgaaagtccgggtgggcgatggagataagggccttggcccgctgcggaaccgtcagcccccgcaaacagaccgcgccatactcggtggccacaaagtgggtattgctccgggtaagggtcaccacggccccctccggcagtaccggcagtatacgggactggagacgccgctcccccgtgtccgggtcctttgcagagtaggtggagcgcagggtaataaccgacttgccccccggcgccatctgtgcgcctacggcggtgtccacctgtccgccgctgcccgagatctgccggggccccacactctccgaggcgcactggccggtgagatccacctggagcgcagcattgatggaggtcatgccccggttggccgccaaaacagacagatcgttggtgtagctcagggccttgtggaggatggtggggttgtcatccacgaaatcatagagggcatggctgcccatggtaaagcacgtcaccgtcttgccccggtggaggctcttgcggctgttgtccgccgcgccgcaccggagcagctccatggccgcgtcggacatggcctcggtgtgaatacccaggccccgcttgtccttgagctcggcggccaaggcgttgatggtacccccaaagccgagctggatggtggccccgtcctccaccagctccgccaccacccggccaagctggcggtccacctcatcggggggctggggtgaaagggcggcggggtagcggtcggactccacaatggcgtccacctgggagacatggagggtcacgtccccgaagatccggggagcacaggaggccacctccaccaccacccgccgggcgcgggggagcacctccagctcaatgcaggccgagcccgccagggaaaagcagccatgcttgtccataggggagaccgtgagtaccaggcagtcgtactccggcgccccgtgggtccagtccctggccgcattgcgcaggtggttgggcagaaaggcgcagcggcccaggcgctgggcctcctgctggtaggtgttgtaaaaaatcgactctatttgaaaggcgtccccgcaggcggggtcggtaagcagagccagggactccaggggcaggtagttgagcacccgtaccccgtggagctccgccgcccgccggtggagggcggcggcaaagtccactgggagcagcgggccgcccgccagatagacggtgtccccggagcagatgcggcctgcctccgcctccgcggtggtgcgccggcgggcatattccgcctcaaacatgggaaagcactccttttcttgcacagagggcggggcagccaggctgccccgccctctgaagattgattcagacaggagaattacgcgtacttctgaagcgcagcggcgcccttctcggtgatgcgcagcttgcgcttgaacaggccgccctccaccacgtagccgcggcgggtcaggtgggagcagattgcggacatgcgcatggacttaatgccgtttttctgcacaaactccgcctgctgctcggggttctccttgaccaccttcaggagctggacatacagggggttcaggaactcctctgccatctcggcctccttcccgctgagggcgggcagggccgccagccccttctcggtgatggtaaaggtgtagaacttggagccgctcatgccggcacggaccaggtagccgccctgatccaggttctccacggcggcgccggaggtcttggagtccacccccagggcgtcggtcaggtcggacatgtagcagtggccgatgcgcagcatctccagaatctgcttttccaactcgcccagcttgacctccttacggttggaggcggtgggcacccgctcccagccggggcggccgtaatacttgggctggccgaacagggaggcgatcaccgccaccaccagggtgaccaccaggcccagggtggccagatacacatagctgttgatggagaacaccttggtcaggtccagcagggtgaacacagccatggtggccatgccgcacaccgcgccccacagggcgccgcggccgttaaaccggggccagatggcgcccaggcccagcaaaatggcggggggcaccagccagcagttggcaaaggcgaacaggtaggtggggccgccggggaactggcagagcacgaaggtgaccacgccgatgagcagcatgatgatcttggacatcttcaggctcttctttgcgtcagccttggggttgatcaggcgctggtagatatcgcggttggccacagcggaggcgcccagggcggaggtggaggcggtagagatggatgccgccacggcgctgataaccaccagggagccaaacagagacacgaaggtcttggccacatagccgtaggtgccggtaggagccacggtaccgccgttgagggtgagctgctcgggatagaacgcgcccatgtagccgccgatgaagcacaggggcaccatgaacaccacaatcaggatgatggcagcggccacgaaggagcggcgggccaccttctcactgcggcagttggcgaccttcatccagtagtagttgttgccccaaaccagggctacggcgaagcagataatgaagttaaacaccgaggggtaggtcagcttcatgccgggcagcgcccccacaaagccctggctcatgaagtcgccggcaccccagttggcgctgatggcgtccagccagccgaatcgtccggccaggatgaagaaggtggcgggcaccacaatcacgccgatgagcacctggaacaggtcggtgatggtggtggcccacaggccggagacaaaggtaaacacgatgatgacagcgaagataatagcggtaatggccaggcggttccagccggtgaaggccgcaatgttgtccacactggacaccacgttattggccataatgccgcacatgccgataacggaggtgatggccactacggaacgggtgtgcccgtcgtagcgcatctccagaaactcgggcagggtctgggcgccgctgcggcggacaaagttggagtacagcaggccgaagatcagcaggccgcacaccgagtagatgacaccccaacccaggccgcccagcaggccgtactgaatcgtgaagccgggggccagtgtgaccgtggtgccggcaaagccgatagcaatgacgcccaccacgttgatgggggtggaaatctcacggccggccagcacgaagtcggaggactccttgacccaccgcttgctgatcaggcctgcgcccaatagaaacgcgcagaaaatgacaaatatgacgacaaatatgacgttacccacgtttgtccctctctttcatatgtatggttgtttacactgacacaacaaaagggttactccacgaaggccaccacacgggcccagccggcggaggcggccttgatgcttaccgggaagcagcttaccttaaagccggtgacagggagctgatccaggttggtcagcttttcgatgtggcagtaggccttgtcgcggcccacccggtgggcctcccagataatggaggcatcgtggttcttttcaaactcctccccctcgaagggcaggggcacatcccagctccagccgtcggtgcccaccacacgcacgccgcgctccagcagccacatagtggcctcatagctcatgcccgcgcccgcaaccaagtactcaggcttgccccagcggtcatcggcgtcggtgcgcaggaagacaatatcgccgggcttgagggtgtagttgatcttctggaagtactcctccacatccttggcggtgatcttgtatccatcgggcttgtcgtggaagtccatcaccacgccgtcgcccacaaaccagtccagaggcacctcgtcaatggtccaggcccgctcaccgccgttcatggtggggtaatagtggtagggggcatccacatgggttccggaatgggtgcacacctgcaggaactcgattccccagccgttgccctccggcagatcctcaacggtgcagcccttaaagaagccagccatctgctccgcggtgtccttgtggttgcaatactgaatcttgggaatctggatcgggggatcactgggcagtccgtcttcaatgggaatagacaggtcaatgattttcatagtggttacactccttttgattcggccggtggccgttgcttgcgtctcataagatagcaatttctgtgccaagtctgtctaacactctgcaagccgttgcaactgtaagaaaaagcggttattttcattgacatccaggcgcccaaacactgttcggtaatccgtacatttgaatattttattttgagctgtcttttggcaatccccctctgttcttatgttttaagcctcatgtattgatttccttacatgttttgttttccgtacatttcgcaaacaattttggacgttttctggcgttttttgtgactcaattttttgcaaaaacccattttctccgcatcaactaaacaaaaagattcattttcggtgaaattaaccattgtaaaacggcgcgcagcttgctatcgttaatacattccgtaccgtgtatgagtggaggaagccgcattggaaaaccacattgatccgagcaccatgctggaatttatcgagggtctggccgccatggcggttctggaccaggacggcgtctacacctatgtcagcccgggctgggagcgctacaccggccacaccgcacaggaggccatcggccggaaggtttgggaaatggtgcccgacacccacgccaccgaggtcttccacacgggcaagccggtctttgccaaggccgtcaacgccaacggccccgcctttacctcctattttccccgctttgaccgggatgggaagctgtgcgggctgtttctctatgtcatcgtccagggtatggaggacgctcagaacctgacccggcgcatcggcgagctgtccagcaaggtggagttctaccagcaggagctgtcccgggagcggggcgcacgctacggactggacaacatcatcggcgaaagcgcctcggtcctccgcctgaaggagcagatcgtccaggccgcccgctccacctccacggtgctcattgagggggagacgggcagcggcaaggagctcatcgcccactctatccacgccatgagcgcccgcaaggcggccaactttgtgcgggtcaactgctccgcgattccggccgagctgatggagtccgagttcttcggctacgccgccggcgccttcaccggcgcggcccggaagggccgcatcggccgctttcagctcgccagcggcggctccatttttctcgacgaggtcaacctgctcaccgccaccatgcagcccaagtttctccgggtacttcaggagatggagatcgacccggtgggcggggagaagagcattcccatcgacgtgcgggtgatcgccgcctccaatatcccgctggagacgctggtggaggcgggacaattccgcagcgacctctattaccgcctcaacgtcatccgcatccaggcccccaccctgcgggagcggaaggaggatctgcccctgcttgtggacaactttatccaccggctcaactaccagctcggcatggtcatcgagggggtggcccccggcgccatggacctgctgatggattacgactggccgggcaacgtccgcgagctgcagaacgcggtggagagcgccatgaacgcggctgactcccccatcctgcggcggcgggacttccgccaactggagcagcggatgcaggcccggcggcggcgccagctcaccgggccgggggacttcaagctgcgccccgcccgccaggcctttgagcgggagcttattcgggacgccctggccgccgccgggggaaaccgggtcaaggccgccgcgcttctggacatctcccgcacagtgctctacgaaaaaatggaacaataccaattaaaatagacagactgaggagaggaacattaccatgcagacacaactgagacaggccgtggttgtcgccttcggccgcaccccctactgcaaggcccgcaagggctcctttgcccagctccaccccgtggagtatggcgcccagacccttctgggtgtgctggccagagtaccccagctccggccggaggacatcggcgacgtgatcatgggctgcgccatgcccttcggtgtccagggcggcaatatggcccggctgattgtccagcgggccgggctgcccgactgcgtcaccgcccagaccgtcaaccgctactgctcctccggcctgcagaccatcgccaccgccgccaacgccatccgctgcggggaggaggacgtggtcatcgccggcggcgtggagtccatgtctctggttcccatgctggtgggcgcggaggatgccgacccctggctggcggagcaccgccccgaggtatacaccaccatgggcatcacggcggaaaatgtggcccgccagtggggcatcagccgggccgatatggacgccatggccgttgagagccaccgccgggccgcccaggcccaggccggcggctgctttgacggacagatcatccccatcaccgtccccggccccgacggcggcgaggtggtggtctgccgggacgagggcatccgccccggcaccactgcggagacgctggccgggctgaagccctgcttcctggaaaacggctccgtcaccgcagccacctcctcccagatgaccgacggtgccggcttcgtggtgctcatgtcggaggaaaaagccgcagagctgggcgtgaagcccctggcccgctttgtctcctttgccaccggcggcgtgcctgcggaggtcatgggcgtcggccccatcgaggcggtgcccaaggcgctcagaaaggccggccttaccctggagcagatggacaccattgagctcaacgaggcctttgcctcccaggccctggcggtcatccgcaccctgggcatggacccggccagggtcaacccctggggcggcgccatggccctgggccaccccctgggcgccaccggcgccatgctcacctgtaaggccttaagctatctggagcgcaccggcggccgttacggcatggtcaccatgtgcatcggcggcggcatgggcgcggcaggtatcttcgagtgcctgtaacggcagtacagcaggaggccctgggaaccttccggttcccagggcctcctttcttgctgcatacgtcaaaaaattaacgcttgtcatttgggttcttaagtgctatcatcacagtatcatatctatactaatcggtttgaaaaggagaataagcatgaaagaactcgaaaacaaggtcgctctggtctcctcctccacccgcggcatcggcctggcctgcgccaagacgctggccgcccagggggccgcggtctatctcggggtccgccgcctggaggccggacagcagatcgccgacgagctgattgccgccggcgggcgggccggggtggtcttctttgacgcctcccgggaggagagcttttccggcatggtggacgaggtggcggccaaggagggccggctggacattctggtgaacaacttcggctccaccgacgtcaagaccgacctggacgtggtgaacggcccctcagaggacttcttccgcatcgtcaacaccaacctcaagagcgtgtatctgcccagcaaggcggcggtgcccctcatggccaaaaacggcggcggctccatcatcaacatcggctccgtgggcggcctctaccccgatctgagccgcacggcctatggcgtcagcaaggcggccatccacttcctcaccaaggacatcgccgtgcagtatgcccggcagggggtgcggtgcaacgcggtgctccccggcttcaccgccaccgacgccgctctgaacaacatgtcccaggccttcctggatcttttcctgaaaaacgtccccctcaaccgccccggccgcccggaggacatcgctgatgccgtcgccttcctggccagcgaccgggccgccttcatcaccggcgagattctgcccgtggccggcggcttcggcctgcccaccccgctgtacggctcctatatgagcgcgggggccaagggctgatttcccctccagagggcccttcggggccctttttactatgcaaaggtatagcaaaaagggccgtgtgccgctttcggtggcgcggccatgaacgcaacagcccgtgggccaggacggcccacatgcgcaaaagcttcctgcgcaccggcgtttgcctgggcccgtggtgcgctttaagcccatgaagtttgttgccccgtccgccccggacgtgctatactatagtatcacaccgtaaaggacggcagctatggacaaactggttgtaggcattctggcccatgtggacgcggggaaaaccaccctcagcgaggggctgctctacacctgcgggcgcctgaaaaagctggggcgggtggatcaccaggacgcctttctggacaccgaccccatggagcgcgcccggggcattactatcttttccaagcaagcggtgctccctgtggacggggcggagctcaccctgctggacacgccgggtcacgcggacttttccagcgagatggagcgcaccctccaggtgctggactgcgccatcctggtcatcagcggcaccgacggcgtgcagggccacacccacaccctctggcggctgctggagcgctacggcgtgcccaccttcctgtttgtcaacaagatggatctggcgggggcggacaaggccgccctgctggcggggctgaaagccgggctggacgaggggtgcgtggacttcaccgccccggcggcggagcgggacgaggcggccgccctctgcggcgaggacgcgctggagcgctatctggaggacggggcgctggacggcgataccctcaccgcccttatcgcccggcggaggctcttcccctgctggttcggctccgccctgaagctggagggggtggccgaattcctccaggggctggtggcgtacgccccccggccccggtatggccccgattttgccgcccgggtgttcaagatttcccgggacaaccaggggaaccgcctgacgtggatgaagctcaccggcggcgccctgcgggtgaaggaggccctctccggccccggctggacggagaaggcggatcagctgcgcgtctactcggggtccaggttccagaccgtggacgaggcccaagcgggaagcgtggtggccgtcaccggcctgagccgcaccgccgccggggagggccttggggcagaggcggaggccctgccccccgccctggagccggtgctcatctaccaggtgctcctccccgaggggcaggatccccacgccgccctgggcaagctcctcctgctggaggaggaggatccccagctccacctcgtgtggaacgagcggctgcgggagatccacatccagctcatgggggaggttcagctggagattctccaggcgctggcggcccagcgcttcggcctggcgatcaccttcggccccggcggcatcgtctaccgggagaccatcgccgccccggtggagggcgtgggccactacgagcccctgcgccactatgccgaggttcacctgctgctggagccgctcccccgggggagcggcctggagctggccgccgcctgcccccaggacatgctggacgggaactggcagcggctggtgctcacccatctggcggagaagccccacctgggggtgctcaccggctcccccatcaccgatgtgcgcatcaccctggtggcggggcgggcccaccttaagcacaccggggggggcgacttccggcaggccacctaccgggcggtgcgccagggcctcatggaggcggagagcatcctgctggagccgtggtacgacttccggctggagctgcccccggagcaggtgggccgggccctgtccgacctccagcgcatgggcgggcaggctggcacgccggagaccgccggggcgctgagcgtgctcaccggctccgccccggtggcaggcctgcgggactatggccgggaggtggccgcctacacccggggccggggacggctgagctgcaccgccggcggctacgccccctgccacaacgccggcgaggtggtcgccgccctgggctacgacccggagcgggacgtggacaacccggcggactcggtgttctgcgcccacggggcgggctacaatgtgaagtggagcgaggtcaaggcccacgcccatgtggacagcggcctgcgcctgggggcggagccgcccccgccggaggaggccgcccccgtccggccccgcagcgtgtcctacgccgcctccctggagcaggacaaggagctccaggccatcttcgagcgcacctacggcaaggtggagcggggcgccttccgcccccagcccaagcccgcccgcaccagcctggacgaccggaagtactccatccaggcccagaagaaggggccggaatacctgctggcggacggctataacctcatcttcgcctgggaggagctgaaggcggtggcccgggacaacctggacgccgcccggcagatgctcatggaggtgctcagcaactaccagggcttcaagcagaatatcgtcattctggtgttcgacgcctacagggtgccccgcagcgtccaggacgtgacgaagtaccacaacatctacgtggtctacaccaaggaggccgagacggcggacacctacattgagcgggccacctacgagatcgggaggcaccaccgggtgcgggtggccacctccgacggggccgagcagctcatcatcctgggccacggggccctgcggctgtcggcctccgccttcaagaccgaggtagagcaggtagccggccagatctccgccattctggcggccaacaaccgttccgccccctcccagccggtggccgccgccctggagagggcccggcgcagacaggaggacaagccatgatccccatggaaatcatcgccaccatccgcagcgactttcccaccaagttcggcatcccccgccagagcggcctggtggaggagctgcgggccaccgtggtctttgagccggaataccgcagccccgacgcgctgcgggggctggaggacttctcccacctctggctcatctggcagttctccgaggccgtgcgggacaagtggtctcccacggtgcggcccccccggctggggggcaacacccgcatgggggtgttcgccacccgctcgcccttccggcccaaccccatcggcctgtcctgcgtgcggctggagggcatccggagagagccggagctgggtcatgtgctggaggtctccggggccgatctgatggacggcactcccattctggacatcaagccctacatcccctacgccgactgccgcccggaggccagcggcggctttaccggcagcggcggcggggccaccctggcggtggacttcccgccggagctgctggagcgggtgcccgcggacaagcgggccgccctcaccggcgtgctctcccgcgacccccgccccccctaccagcacgatccggagcgggtatacgggctggacttcgccggggtcaacatccgcttcaccgtggacggggataccctcaccgtccgggcggtggagcgcatggcggacaaacaaaacaggacaaatagataaaacgccgggcggccaaggccgcccggcgcttttacgtctatgccgtctgctccagcaggagcgggtagagctcagcctctcccgtcccctggaaccagaaattccaatagtcatccatgtagtagtagaccagattcccagggcagaaggtcatgcggtagtatccggaggcgtcggtgacggtaacgccctccggctcctccgccggggcgggcaggggcctctccccctccgggccgtccgcctcagtcagcccccggaacgacacagacgggcggcgcagtacttacttagtcacccagtggatagccgcaccctatatacaaggggcggcccaaacctttgttaatccctggggcccaaggcctggcatccgctcagatattgggcatctttgcagtgggcatcatcagcacctttccggtaccacggtatacgttcacaaggccctcaccagaggcggccgagccgattaggctcttaccggagcgctccacggtgaagtccaggctcttactccaggcaattgcatagttgccgtccaccttcagtacatcgttctggagggtgatctcgatcaattcccccttgggacagtcggactcgatacagaatatgccgctgccgttgaggctcaggttaaacagcccctcgccgccagccaccgcggaggaaaggttggagcgcatgaccgccttgtgctgcaggctggactcacaggccagaaacaggccgtcgtccagcacgacgctcccaccccagtcggcagcgtccatcaaaataaggtgcttataggttggctccagcaccagcagtccgtcgccggtgtactccggcttaattgcagactcaccactggccttgccgcgcaccgccttccccaggaagtcccccacgcccttaatgccggtggtggcgttcacgttgcccagcatccactgcatggcacccgcctgaatggtcacatgggacttgtgcagatggcataccagttggcgctttttgacgttcatctgtgcgctgaagtaggccgttactgcagaggacggcgaaacgctcaaatcccgctggtattcaatgatctgaaaggcacccaactcagagagcacttttacgtcatcattctcggtaaaattggagacctggtacataggttttcctccattcaattgatatgggtaggtctttttatcatagaaaagatatatgtttattataatatacttccgtcttcgccacaagaaaaatgtatattttatagaaatatcacaagcagtaggaagccatcacatcgccgcattcaggagcaccccgtttcccatatgccctccccgcttaacgcccatcccgcatctcgtccagcagccaacggcggtactccgccgcctcctggctgtccggctgggcctggagccaaaagtccacctgccccagcaagcgccgcaggcactgctcctgcggctcggcgtagatctccgccgggaaggccgcctccttcacctggatatagcggatactgtcgaaaaagtgcaaaatgtccagcttcagcagctcggggcggcccacatgccgccgggcattctccaccacccccgcgccgtatcggtaggcggtggcatggggcgacacgggcatgcccgagagcagcacccgggcgatgcgccgctggatgtccttgagcacagggtccggcacccggagcacccgcactccgccgtcccgcttgggaacctccgcccggtggtagtgggctggaatccggttgctggcggcatacagggtgcggaggggaagccccaggtcccgggccagggaggggccctcttgatagacgattcccatggccgcccctcccttcccggttcggaacaaaacctgctgtatggcgaacggcgcggcggtatccccctgcacaccgcaggtgtgctgaaataccgctgcggcgcttcggcggagcgaagcgaatacgcgtgagtctgcgggaccggccgcgattcgcggccggctccggcgtctgagccgggcttctcttttgttccgtggtcccagcatagcacagctccctgaaaaatacaagccgggccgccgggaattcccggcggcccgactcatatacagcatacttcggccggtgttaccgcatctcctccagcgccctgtactgggtcttgcccgcctcatttttgggaatggcctccaaggcccggatctgaaagacccgctccgggaagtgcatctgttcgctgagatactccgccgccgccccggtcacggcgggatcggggctgtcgtgaaagattcggaggaggtcatccctccccacgcaggcaaagcccgtgtccgggaagcgggcggcaagcagccgctccacctcgtccaggcccacccggttgccgtagagcttaataaaccgcttcttgcggcccacgatgtagtagaagccgtccccgtcccgccgggccatatcgccggtgtggagctccccgtgccactcgtcccccagggccagctcctccgcccgccgggcgtagcccatggccacgtttggcccgcggtagaccagctcgcccacggtgtccggcgcgtcaatgggcgcgccgtcctcccccagcaggcggaactgaccgccgggcaccggcacccccatgctgccgcacttctccaccgcccgctccgcgggcaggtagcccatgcggggggccgcctcagtctggccgtacatgacaaaaaagcgccgtcccgtccgcgccgcccagtcggcaaactccaggtgaagggcctccggcagcttgccgcccgcctgggtcagggtgttcagcgcaggcagctccatctccagcaggcccgcccgccggtacatgcggtaggtgtagggcaccccggccagggaggtgacccgctcccgctccaccagctcccagaagggccgctccagcacgctgcgccgggtgagcaccagcgccgcccccgccagcaggtgggtgttgacgatggacatgccgtaagagtagctcatggccaggttggtgacgggacgctggccctcgtccagctccaggtactccacgatagagcgggtgttggcatccaggttccggccgctgaggcgcaccagcttggggctgccggtgctgcccgaggtggtgagcaggagggccagctccgggtggagctccggcccctgcccgccggggcggcggagcagggcgctgtcctccacctccagcgccgggacaaagccctccagcacccgccccgtctccgccgggaggtcgccgggcacatggacaaaggcggggcggtaggtctccagcaggccgcgcagcagctccggcgcaatgtgggcgtccagcagcaggggcacttctcccgcctttaggcaccccaggtagcccagcagggttccgggggtgttctcacacagcacaaagaccagccggtgctcccccacagccccggcaatccgctccgcggcggcgttcaaatcccccagggtgtaccgtttcccctcctcggtgacggccagcagccgctccggctcccggtcgcagcgcgcaaacagttccatgtgctcctcctatccaatgatgcgggacagggcggcgatcagatccctcccgtcccagaccgtatccatctccagggcctgccccagaggcaccacccgatccacgccccgcgcccccgcccgggccaggagggcggccacctccgccggctccagcccgccgcacaccagggtctgcgccttgggcgggagcaggggggccagcgcctccaggctgggcaagtccgcctcaaagaacagcccgaagcccccggccagggagggcaggtttccggacagccccgccagctgggccacatagagcaggttgccctgatagcgctccacggcgacgacggcaggctcctccatggtcatggcgcagaggcacagccgctccagcttgcgggccgcctggaaggggccgaaggggtagcgctccgccgcctcggcggccaccgcctcccaccaccggccgcggcaggcggggtctcccccgtcctccagccacagcaccagttgggggctggagcaggcgttctgatccatctggtaggtgtcgttataaaaccggtgggccagcgccccccgctcctccggcgtgagggcggagaaggcccgctggctgaacaccgccagcgaccagcggtcggggaagcacagctccacggcgtggggaggcatgggcatggcccgcaccgccgccaccgtggcgtcgccgccccacacgatccgggcgtcgcagcgggcgcagtagtccgccgtgacggcatcgtcccgcccgtaggtgatcaggctggtgcgggcccgcacggcggcgtgctccggccgctccagcacccggcggagggccgccagcaggggggcctccccctctacccgccggctggacaggcgcaccacgttggcgttccccgccagcaggccgatggccagggtgtaggcaaacagggcgggcacattggcgggggccagatggaaggccagcccccggcccagccggggcagcggggaggcgtggcgcgcggccagggcctccaggcgggcccggcggcaccagaagccgaaggcggcggaggcctcctgccgccgggtgtccgggctgcggagcacctcggcggacagctccgccagaaagtccaccgccctggggtcaaaggggggccagggtgcggcgtccacctgctccgccccggccaaaagcgtgacgttatccctcataggtatcgctgcaccccctcacctcggcccggggcacccgccccgtcaccttgaaatacttgcccttgcgcccgcaggggcagtcgtcctcccccagcagcacgcccagatcctcggtcagcagagagtggccgggataggagcggggcagcggggagagcacctggagcacgccctcctctccaggctcgcaggggcggtagtcccgcccccgccgcaccacgatatccgaccacaggctggcgtggaggtggccctgggggcactccatgtaaatgcagccggtctgctcggccatgccgtagtagttgcttacccgctccacgcccgtggccgccgccacccgggccttgaactctccgggtgacaccgcctcgccggccagcttcttccagccgccgccgtgaaccaggatgccgttggggatgtccagcctctccccccgctcctccagggcgcggacgacgtgcttccagatgatgaaggtgaagccgaagaggaagatggtctccccctggtgctcctccaggaaggcccgcaccccgtccagatccagctccatgtgctcgtccagggcatagcagggcctggtgccgaagatggaaaagcccagaatgcccgccccccgggcggagaacatggcgcggttgcgcagaacctgcctgctgtccagcaccaggaagggcagccgccgctcccccaggaagtcggacatgatctggcagagggcctgctgctggcaggcggaggtggcaccgtccagaaagatcctggacacccgctgcccggtggtgccggaggaggtaatggtcttgaacacctctccctccgggatgctccgcagctccagttccttgaacagggataccggcagcataggggcgctctccaccgtacattccatgtgggcggggcagcccagggcgtccagcaggcggccgtactccgggcagtgctcccggtgaaactgggtcagctcggtgagcagtccggcgtaaagcgcccgcttctccgtccgggccgtggaatagggcttgtattgcagcagcgtgttcagctccacaccggcttcactcctttcctttgagaatatagggctccccgtggccggggcagatgcgcaggccggggggcagcccccggagaacgggctccgtgacggcgcggtagtccgtctcgctcccgccgggcaggcggaggatgacctcctcccccggaatcaggtagtccccggagaaaaagatgtccccgtccaggaaaattcctgcgctccccggcgtgtgtccgggcagggccacggcgcggagccggtgtccccgccatacgcactcccaggcgtgctcataggtctcatccgccggccggcagacgaagggcggataggacacccccggcttgccccggaaggcgagatagacctccatcctccgggtcatgttgagccgggtgtcccccaggccggcgctgcacgcggcggtagccgccacccacaccccgggccagcggtttcgcagcgcctccagcccggccatgtggtcgcagtgctcgtgggtcaggaggatccgttccggcgtccaccccagcgcctccagccgctccagcggccccctgggatcgttggggtcgatgaccaccgcgcgccccgcctcccccagcagatagcagttgctctccgccagcggctccgtccaccgctccagaagcagcacggctcagagctccacgccgtacttggccagaatctccttgcccttctcataggaggagaaatccagcacgtcggcggtgccgatgctgattttgaaggtctcctccatgtcccccatcagatccatgtggccaagggagtcccacagggggatgccccggtacttgaggccgggcagctcctccggcttgacccggaaggcggtgaggaacaggcggtcatacttctccagatttgtcatagctcgtttcctttctatcccgcggcgtaagtaccaaatggggcgggccttcggcccgccccatgccgcttaatacttgcagtggaagcgcttctcgtactccgccttgagctcgtcgcggaagtcggggtgggcaatttcgatgaggttgcgggcgcgctggcggagagtctggcccttcagcgcggccacgccgtactcggtgacgatgtagtccacgtcgttgcggctggtggtgacggcggcgccctcatccagcagcggcacgatcttggagattttgcccttgacggtggagggcatggccatgatggacacgccgcccttgctggcggaagcgccgcggacgaagtccacctggccgcccacgccggagatctgcttggggccgatgctctcggaggccacctggcccatcagatccacctgtacgcaggagttgatggacaccatgttctcgttctgggcaatgacaaaggggttgttaacatagtccacagggcgcagctccacgtcggggttgtgatccacgaagtcgtaaaggcggcgggtgcccatgaggaacgccacctcaaacttgccggggtggagggtctttttggcgttggtgatgacgccggcctcggccagctccaccacgccgtcggagaacatctcggagtggatgcccagatccttcttgtgcttgaggaagaggagcacggcgtcggggatggcgccgatgcccaactggagggtggccccgtcgggcaccagggaggcgcagtgctctccgatggccttctcaatgtcgccgatcttggggggcttgagctcaatgatgggggcctcatgctccacgatgcagtccagatccttgacggacaccaggctgtaggggccggtccagggcatctgggggttcacctgggcgatgaccagcttggcctgcttgacggcctccagggtgtagtccaccgacacgcccagggagcacatgccgttctcatcgggaggcgtcaccatgaccatggccacgtccaccggcatggtggagctgaactggcggggcacctcaaagaagaagctgggggtgaagtcgccccggccctcggcgatggcatcccggctggttccgcccacaaagaaggcgttgtggcggaagttctcggcgtactcgggcttgcagtactcggccttgcccatggccaccatgtggacgatctccacgtccctgtaggccttggcgttggccaccattacgtccagcagataggacggctcgccgcaggcgtgggccaccaccacccggttgcccgactggatgtggttgaccgcgtcctccgcgctcatcaggtgctgcttgtaatattccttccaattcatacgatacacaccctctattctttggattttaagactgggctcagcgtgccagatagtcccgaccgatgcggtcggcctccaggatggcgtcgtagacctcctgggcggtgatatcggcgcgcaggttcttggtggactgagtgggcaccacggcggcctccgccacctttttcagggtctctggcacgatctccttcaccccgagctgggccagggtcaggggcaggccggtgtcccgcaggaacccgagcacctgctccagctcctcctggggggccttctccagcaccaactgaaccagggtgccgaaggccaccttctcgccgtggtacatgccgtgggcctggggctcctgggcaaagccgtcgttgacggcgtgggcggcggccaggccgccgttctcaaagcccaggccgctgaggtagattgtggcctccaccacgtcctccagcgcgggggtgacctcgtgccgctccaccgcggccagggcgtcccgccccttctccatcagcaggtcgtagcagaggcgggccatcatcagcccggtattggacacgttgccccgggccatggtgcgggcgccgctgttcttgcaggcccgggcctcaaaccaggtggacagcgcgtcgcccaggccggcggcaaagagccgcctgggggcgttggcgatgatgccggtatcgaccagaaccagatccgggttgcggcgcatgagcacggccttgataaccaccccggcgtcgttgtagagcacggccacgccggagcagggcgcgtcgttggaggccacggtggggatgatgacgcagggcaggcccagattttccgccacggccttggcggtgtccagggccttgccgccgcccatgcccaccaccacgtcgcagccctgggccctgcactcgtccatcttggcaaagacctcgtccttggtggcctcgccgtggaaggtggtgaacaccacctccttctcctgctcggccaggctggcctccacctgggcgccgaagcgcccgcggctgttgtcggtgcagatcaccaaaaacttatttcccagcttcttggcgctgcggcccaggttggccagctctcccgcgccctgtgcatagcgggccggggccttgattgcgtatgtcattgcactgtctcctttttattgggctaccggaaggccagccgcagctccagatccgccgccagcacgccctccacaaacacctgcccccggcaggcggcgatggcccgctccgtcttctcctccagaagggacacgtggatttccagcgtatcccccggcaggattttccgccggaaggtggcctcccgcacccccatgaacagggggagcttcccggcgtaacgctccgtggtcatcatcaggatgtccgccgcctgggcggcggcctcgatggtgtagacgccggggagcaccggcgttccggggaagtggcccgcgaagcagggcagctccggccgggcgcggaaggaggccaccgcctcctccccgggcaccaggcggctcaccgtgtcgatgaacagcatgggctcccggtggggcaggatgtccagcacctcctcgtgggtcaggctccgcgtctgctgccccttcagggcctcggccagcttctccttcgccggcagcagctcctcccacccgctgaggaagatcagccgcccggcgggcaccgccagatcgctgacgttggcacagcgggaggggcagccgcacaccaccagcaccgccgggtacttcaccccggcctgggcggtgacgaactccgcctccgggaaaaagccgccgatgcgcttgaccagggccacccggtcataccggggattacagccgccgcagtagcggacgccgatctgccgtctatccgccatggcgcatcttcaggatggagcgtgcctcgtccagcagctccgggctgatatcctgcaccagcaccgcccgcttgatgtgcgggaggtgctcggtcagcgcggtctggatcagctcctcggtggtcagatcggccgccggacagccggcgcacttgcccttgagcttgaagcggacgacgccgtcctccacctcaataatctccatctcaccgccgtgggtgcgcaggagcgggcgcacgtgctcgtccagcacggcctcgatgtcctcatacatggcggatgcctccttttgcaaagccggagggcggcggattgccgccgccctccggtcgaatacagatgcgattggaatgtggtttttgcttactccttgatgtgggcgatggccttggccagctctttcttgtgggccaggttgccctgacgggagatcatgatgcgctgggcctggggagagccggcgccgtgcatggactcggtgcggtagccgacggcggcggtgcccagggacaggttctcgatgaggcgcagaatgcgcaggcggttctcggtggagacggtggacacgcccttgaggtacttgtcgatgacgggccccagcttctcgtcgcggaagtcggcctcgccgggggcggtgaccatcaggccgccggcgatgtcctcggccagacggacgatctcataggggaagcgggtcacgttctgcttgcagacgttggccagcagcaggtcgatcatgtagttgccgctctcggtgggggcgccctcggcggagcaggcgatgccgcagcagtacagggtctcgttcaggtgggtcatctcgatgagcttatccttgatgtggctggccttgttggcgccgttgtagtcggcggccacggcggcggcgccgatgagcacgtcgcccacgcccaccttacagccgccgtagctctggcggtgatagccggcgaaccgctccaccagcatgccggcgtactccgtctctccgttcatgaagatgcggtcgttgggcacgaacacgtggtcgaacacggtcagggcctccacgccgccgaactcgctgttgcccacgtccatctcgctgccctccagcttgcgggtgtcgcagctctggcggccgatgatcatgaacaggcccttggtgtccaggggaacggcgaaggagatggcgtagtccttgtcgtcggggcccatggactgggtgggcatcacgatgacctcgtggctgttgatgatgccggtctggtgggccttggcgccgcagaccaccacgccgtcgggccggcgctccaccacatgcaggaacatgtcggggtcgtcctgggcgtggggggccttggagcggtcgcccttgacgtcggtcatggcgccgtccacggtcaggtcgttctcctggcagtagagcatgaacttcttgaagttctcatgatagctggtgccgtacttcttgtcgatctcataggtggtggagtactcggcgttgaaggcgtccatgcccacgcagcgctggaagcaggcggcggtcttctggcccagcaggcgctgcatcttcaccttgttgcgcagatcttcggtggagcggtggatatgggtgaagcggttgatgcgctcgccggtctcgggggagatggcggtcatcagctcctgatactcgggcatctgggccaggtcataggtcatacgcacgctgttcagggagggccgcaggatcggattgtcgaccggattctccaccttcttgccgaacatgtagatttccatggggatcttacggatgctttcgatgtactgttcgccggtcatgagtgccataatagaggacttcctttctcaatcagattcaatcaatctatgtttttgaatacccagaactcaatggaactactggttcgccttgtcgtcggcggcaccgacggccacctgctcggaggccttctttttgccctcaaaaagcataaagaacagaatcagacccactgcgagtccccaggcggcaccctggatggccagcaccgcgcccatgacgccgcagataccccgctcaatgtcggtgcggcacatgttcatggccagttgggtgcagatgaagccctgcacgatcagggtcagggacagggctacgggcagcacgggctgtagcagggaggagatggggatcagggccacgcagataaaggtacaccagcggaaggtaccggcaccggagtagatggactccatggccttggggccctccttgtaccgctgggacacagcggcagtaacggccgcccacaggggaccgcaggtctgggtgtaggggcagcacagcgccatggccacgttccggataccgctgatgacgttggagcggttggcgttgaagtcaatcttctcatcctggcggacctcatcggcggagcggagcagctcctccgaggtgacgaagtcgccaaaggcaatgatatacaccacgatggcggtggggatggcggcaatccaggtcgccgcgctgggccagccgatggcaaagggagacaactggttccagatgttgccgaactctgggatcttgatgaggggccacaactgaacagcaggcaccgcgatctccttcacaatggggcccagaacgacaccgatgatgatagccggcagcataccgaacttgccgattaaatcaatggccttgtatttccggcgcaggttggcccatatgggactgaacaggcagaagtaggccaccagcacacccacggtaatagagatgggatacgtccagaaacgaccggtttctcccatctcgccgatgatggccgctaagccgccgcccatcagtacgccggcctttacggagtttggcaccaagtgtaccatcttgccgccgataccggtgataccgaacaccaggaagataaggcccagaatcaactgcatagcaatcagcgcctgggtacgctcagggcccatctcatatccgtcggtcaggaaggcggtaatgatgggaatggcaggggtgatccacccgggcaccacggggtcgcccagcaacacatgcaggttgtagaagaagccgttaatgatgaccatggacagggctacaccgtacgaaacgcccaggacctcttgcagcacggggatagcgcccaggcaggtcgcacacatgaacacggcctgcaccatctcgggaaccgaccatttgtagtggacaaaggggaggcggatcttgaaaataccggccttccagtagggctgttcttcaccgtatttacggtaacggctgacaaattgttcgtttgccatttacgttccctctttctcatcccaaacaggagttttgtcagtctcgctgcgacagttggccaactgttcgtgacactccttcttttatgcatttcacatgccaacttcaaaaaaaaggcccaatcaactgccgcgcagttgattgggcttttcccccgagaaatccctctccctgtttgctgcatttctgcatcaagagatcatcggttaatttaaacttatctaactgaaaccaattgacctgccgcaattctgtaggctggtgcatttttacagcgcgcgtttcatttttgcagcagctcctcaaacttgcggcgtttgcggacaaaggtggcgctgtccatccccaggctggccgccgcggcccgcaccgttccgtacttctcataggcgcggcagatatactcatactcgaaccgcgccacctccagcttcaggttcacacgcccagtctcgtccccgccgtggctctccccctcaaaccggcaggcaatgggcagctcggagggctggatctcgtccccggcgctgaggatcaccgcctgctccactacgtttttcagctcccgcacgttgccgggccagacgtagctgtatagaatctccatggctgcgtcggcaaaccgcttctgatagcggtacttcttgttcatgtccttgagaaagctctccaccagtgggcgaatgtcccgcttgcgctcccgcaggggcgggatctcgatgggcaccacattgagccggtagtacagatcctcccggaaggtcttttcatgcaccatgtccagcagattccggttggtggcggcgatgatgcgcacgtccaccgagatggagcgtacgcctccaactcttcttacctgcatctcctgcaggacgcggaggagatgtacctgcatctcaaggggcaggtcgcccacctcgtccagaaagacggtgcccttgtcggcgctctcaaacacgcccatctttccctctttgctggccccggtgaaggcccccttctcatagccgaacaactcgctctcgatcaggctggccgggatggcgccgcagttgatgccaatgaagctctgccgggcgcgggcggagttttcgtagatgtaccgcgcaaactgctccttgcccacgccggtctcccccagcagcaggaccgtcgtgtccagggtggccaccttctgggcccgggccagcacctccagcgtgcggggatcggccgccaccatgcgggagacaaacctctggttgcgctgcaagaactccatttcggagcggcggcgctcctcgctctcctgatacttccgctgcaggccgtagatctccgtcatatcccggaccaccgtgatgatcatggtgatttccccgctgctgtcaaagtggggggtgctggtgatgagcgcctgtttgccggtgcggaaggtctgctccagcgtcaccggctttcgggtcttgagcacccccagggagccggagcggtcaatcatgccggtagcgacaatctcctgcatgcttttgcccagcacgtcctcccgccgcaggccggagacctcctcataggcgcggttgatcaggatcgtgttggcctgtccgtccgtaatgtaaagtccgtcatagatgctgttcaggatcgtaaagagctgtcggttgagctcccgctcgcttccccgcagcagcgtggcgttttcagcaatgaaaatacgctcggactcctgcatccgtctcctccccttcttgcgttccgtcagctcttgggtacttccccctccagtattacaatgggcatgccgcacttcccggtaataaacgtatcgaagcggtccagctccgccgcatcccgaaacgccgagacggggatgatatacgccccctgcccgaaatagaggaaccgccagtccttcagagcggccaaatggctgacctcccggtagcgaaccgacgtggcttccttccccactgtggtacggatatggtcttcctggaacaaaaactccacacgggcgggatattcgccccgtttttccgcatcacggatcgctttccggcacgtcttggcttgagcgcgccgcgcgcccagggggatcaccgcgaactgcagaacaataaacgcaatacccaaaatgcgtatgggcaggaccgtatgattccagttaaataccagcagaacggcgatcaccaaagccacgctgatcagggcgggataggccatcacctccatcctgtgcttctggaacagcttccaggtggcctttgccatggcctgatacgcctgcctgtcatacgtgctctcgatccggaagtcgctctcgggattcatgctccattctccttccaatctgtgttgcgtgcatgcccagtttaccactccaaacttagaattgcaagaaaatacctctgccggcggatggctggcattatcagggacatcgggagagccggccaccggactgtgaacgtggtacaagctttgcgccaagcctaacgtttgcaacgctatttcaaactattacgagcttattgttagtgcctgcatcgtccctaatgcccgaaaactgcacatgaaaatcctgcctctggagcacatccgggacgacttggaggctgctagggtgtgggtactcctgcacatgttctatttggatttggacaacgctctgcgaaaaggtgaactggcggccctgcggttggacatgtggacatccaaggccggacaattccggtgcgcaggcaatacgtccgtaaccctgactgctccctggagctgacccactccaaaacggagaactccgtcgggcaggtgtccatcccacaggctgccgtggaactgctcatccaggagcacgaaaagcacccggacagaatggtaaccctctataaataaattttaaaaacacgggcctagagcacctcatgttccacgacctcaggcccacctttgccacaacagccctgcaaaatggcgtggatgtcaaaacggtttttccattctgggacactacgacgccgggtttaccctgcgcacccgcacctataccacgcggtaaaaacagggtgaagtggcccataccgctatctttagcctgcatcttgcgctcggccgcccgtaaacgggcatattatcttctatttgaaactttcttgtcactatcactgctttttgctaaagcatatgggggaagcccaccagtatagctggtggttctttctcccccaaaaataaagccgcccttttcaagcgaaaagagcggtttttgtgaaattggactccaatctggatattttcagatcctgcgaacggttccgaaagtgcacccaaccggccttctggctggcggcgcttttgcgccgtacaaacgttttggccgaaggccaaaaccttggcgcagggcaactttatttcgcctgagcatgtaaaatctctctcggtatccataaaaataaccacacctgacggtgtggttatttttatggaacatcgcaacactatagataccagctttcagacttgcatttaaaaccaaactactgtaatggggatgaaaagaaatgcttttgaatgcgaccgaaatgaaacccaagtcgcattccagtcgtatttaattatgtgtactcgaaccaaaatcatttgcaaaccattttgcaccgcggttttttcccttacaatatacgcgattttcctgccgaagttcacgcatgagaacctgtaactgattccggctttgcccgggtaacacctgttgtaattccttgaatggcgttccgtactcgccgctttcgcggatgtgcttcagtagcagttccttgtttgtttcacgatccaaaccaacgatccgcgtatgtacaccggattttccaactgcggcatataggctgcgcaccaaaacatatctgttgcggccgatatgctctactaatcccagattctccaaacgttttaagttctgcctgagattctgaggaatgctttctgcatgatacattgcgttaattaccaaaaaatcgccagtggtcaacgactccatccgctcatcgcctatgcggttaatgagcgataacattttttcgtccagcaccataccgtttagagttaattttacgaaatcttgatctgtgcctgtgaaatcaggcagttgttttgcctccttaatgctccactcatacatcaagttcataccctgaccagagcgctcaaccagaccacaaagcgctaaaatttcagcaatacggcggtttcgtggcgattgccggtccaggatattttcaatcgtaattccatttggaaagcctcctggactctctactacaagccgatcttggtactgccggataaacacgctcccccccatttgataattccggtgactcactgcattcaagatcgcctcacgaacaacgcgttcgttaaatgttggaatatcataaacaaaaaaaccttcctgatagtgttgcttatcgttacgcagattaataagctcccacaaacggttatagcaagaaaaaaatcctacccgaaattcctctctctgatttgctgggccagaggcatttgacgagcggtactcaaaaacgatttcagcttgtggcaaaaactttccgagcgctgttcgtttaccaaataacgccagtgccgcatatgtaattctgtcctcatcaataacggcttcacagtctcgcaaaagctgttcttgcgaaagactcattatccgacggttaccgctcttttcagcccatttgttacgaaactcgtctacagcagacggatctaaatcatcaagagttgccccgacgcaaatagtgccagaaaaatcgatccctgcctccgcataaatacgtcgccgaatggtttctggcataggaatcagactatctccttcgtaccaccaggcaacgccatcagcctgcacaggcaggccaactggtcgacctgctatctcaaatactaaaacacgcttaccctcgtgttcataaacttgaaagtcaaccataatgtgcagcttatcgatcaaacccttacgtgtgcgttcgggctgttcaaatgcttggctgcccacaacttgtctagggcgtttatctgaaataccaaagacaagttttcccccgccacagtttgaaagcgcacagcagcaacgaagtgcttctccaaaatcaaaacggttctttgcctccttaaactgaatcccttcaccctcctgagcttccatcaattctccaagcgtcataggggtatacactttggcctcgtctccttatgtattggtttatttgaatgctatcctattattatgacttttattatagcaaggttttgttctttctacaatcgatttctgtccggcatttccagaccttttccttacctcgaggtcagatgtacaactgcaggtttcttttgcaccttgaccatacatgacctcccaagtcccgagaaattccaatgtcgatcaggcacgaagccagttttttatcacgtctgctgcccttattgcatcggtgcgggccttcgtcatatcagtaaggctgatataatcgcgctgatccacactcatgatggctaccggcacatcctgaaccgtgataaatgttgttttcttagattggcttatacttttcccaccacttctccttgactgctatatgaaacaaatgctactctatgctaagatatcattgctgaggtgccctgtcaattctcgaaacagcccttggcaaccggccagtacatcccgccaagcggtgtcgaagtcattagtgtaccagggggcggctacctcctgatccgggtggccggcgtattccatcaggaggtgcatcttgtcgttgaagtcgccgccgcagatgcgatacatgttgcggaggttggcctgatccattccaatgagcaggtcgtactcctcgtagtcgcggttgcggagctgccgggcggcatggccgccgcaggcgatatcgtgctccgccagctttcgccgagctggcgggtagaccggattgcctagctcctcccggctggtggcctccgaggcgatctggaaccggtcctccagtcccgcctttttcaccaagtccttcatcacatactcggccatcgggctccgacaaatattgccatgacacacaaaaaggatcttcttcatgctccagacaccccactgatactatgttgctctcagtataacaggtattgtccggttcgtcgagttcttcccgcagccatgctccggcttggatctgttccagcagctccacctttgtccagtggtgccccagagcggcccggagataccagatgcgctcgtcaaagctctcacagccttctaggatggccatattttgtgtccagcccagcttcagggccagcgccctcagctctgaattgtcggcataggcgcggtaaaattcccgcatccgccgcaggtttcgcggggagaatcctctatccccagggtagtttgcctggagatactcggcggccatgaccgccgtgcccttctccgggtgggcacagacgatcttgccgatctcaaagtacagctccatctgcgggaactccgcccccatgagctgatccagtatcccatacatggcgctgtaatcggttggctttctgacgttcattgagctctcctttctggcgccccgcgcctgctttgatcgcaaaagggagcacggcgtctgatgcaccgtgctcccttttgtggtcaactacataagtgtttggaagatgtcgctctccagagtcaccacatcttccagtggaatctctgtcccgtctgtcaaaaccaggctccgctccagttctctgagctttttcagtcggccggtggtggtcaggtaagccccgccgtccttcttttcgtcccgctggaaccaagtgacggtgagctccggccgttcgtccatgtactccagcagcacggcctgcctccggtccaactctgccttggtgtcctcatccaactctatcttctgctccgtcagccgggcggtctcggcaatggcggccccgtggccgctcagggcggcaaagggactgaaaatcgcggcccggtcgcggatgggcatccgggggtgccgcttggaggtgggatgcgggaggtttatgatgtcgtcgtatggcccactcatgcctgatgccctccgatcgtttggttgcgctctttggccgtggcgccatcctccaggttcatccccttgaggatggcgttcttgccgtaccgcttcttgatgcccagcatggcctcctggagcttccgctcccgggcatgggcagcctcgcccgcctgttcctgttgttccctgacggagtagtcggtgaacagatccatctgctccgcctcgtgcccattgggggcctccgcctcatccagcagcttattggcgctgatgctcagacggcggatgagcaggttcttatccacaatcctgtcatagagggtggctgctgccttttgcagatcattggctgacgaggtgtaggtgaagttctccgtgcccactgcgtgcttggggatgctccgtccgtagcggtcagtggtcaccgggccgtggtagttctgacggcggcctgggtcgtccaggttctcccggtcatagcccacagtgagcaccagctggttggtcaccagccgcttgtctaccagatccagcgccagggcatccgccatctcccgtaccaccagacgggccttgtcaaagtcataggggcactgaagcacctggccggagacgatgctcttgttctccggcttgtacgccttcacgtccgcgatggtgcagggctcccagccccaggcgtggtcgatcaaaatctccgcgttgaccccaaacagcttgtagagcagctcctcattgtggtaatctgtaggcttgccaatggagcaccgggcgatgtcccccatggtgtacaggccgttggcctccagcttgcccgcgtagcccttgcccacccgccagaagtccgtcaggggccggtgcgcccagagcaggcgacggtagctctcctccgtgagcttggcgatgcggacgccgtgccggtcggcccggatatgcttggacacgatatccatggccaccttggccagatatagattgctccccatccccgcagcagcggtaatgccggtggtgttcagaatatccaggaggatggtctgggtcagctcccgggccgtcattctgtaggtgtccaggtagttggtcacgtccatgaacacctcgtcgatgctgtaggggaagatatcctccggcgcgatgtatttcagatagatgctgtagattctcgtgctccagtcaatatagtgggccatccggggcggggccaccaggtagtccagagccagagatgggttctcctgcaccgaccggtcgtgccaagaggcgccggtgagtcgtcggcccggggcctgccgctgtcgccggagattgacctctttcaccttctgcactacctcaaagagccgggcccggccggagatgccgtaggctttgagggagggggacaccgccaggcagatggtcttgtccgtccgccgcttgtccgccaccaccaggttggtggtcatggggtccagcccccgctccacgcactccaccgaggcgtaaaagctcttcaaatcgcagcaaatgtaacacttctccttcacgccccagtcactcctttcgcacttagtatgtcatgggtaccgtccaattatcgggtccagcccagcacggcatccagttcctcctgctctgcctccgggaaattcctccagatctgttcatcgatcagggccttggactccgccggagccacagagtaggcggatgagacgtggtcatagccccacagggtctccggggtggaatagacggagatgtgccagccgtactcctgcccccgcttgttccgcctccgtcggaagtcccggatgagcaagtagccgcccatctgcaggtcagtcaccgtgccctcgaagttcttctccccgcctttgccgaatccggcctgccgcttgagttcaaaggagaagcacactcgtctttggtcaggaactggtccatgatccgcttctgccgcatggtggccagctcctcgtcccagcggctgtcgaagtcgtagccgtccctccgccagttggcgaagtggggaaaccacgctctggagatgaagcccgccttgccgccgaagaacttgccgtaggccgccctgccgctgcgggcgatcagccgccgccactcccagggatcctgttcctcgtcccccgtccaccaatagaggtcggaggtgttctcctccgcggagaagctgtctacctcgtttttgaacaggggcaggaagcccacctcgtcaatcaagccgatgagctcctcccagctctgggtgcggctggggtcatcccagtccagcccccgcatgatccactcgccgtcctcgatcgccatcgtaccgcctccccggagtttttcaagccaattatagcacattcgttctatctactccatagtggtgagatattttcttggacagaaggccgcaaaggaaaaggcggcggatcaaaacgccgccctttcccttacggccttctctataaaatctgcacgatttgctcccacaagaggatgtgcttggtatcaatggctttgtttccgtggtagtgcccgaacagccagtagtggtattgcacccggtctttgacctcctggaggaagtccgtcaggtggtccgccacattgtgccgggagaactggagagcaatgctggtgggggcgcagtgagtgaggatgtagtccaccgcccagccgtgggcgtccaggtttcgtctggcctctgcatattcctcctccgagggtaactcctccctccaccaggacaggtgatcgatgcggaatcgggcgtgctccttccgcttcaatgtcaggtattttcgctcaaagttgggatcttccaggctgaggatgccgtcctcaatgtcgtgggaggccgccccgcccatggtgaagaaggtgcggccggccagctcaaatacctgcccccgcatcaggtggagcacgtggggccggatgggctgcaccctgccgccgtgccagttctctatcgggtatttcacaagggcatcgtagttttcatggtttcccgagacgaaggccaccgtgaagggcagccctttcagccagtccagcgcctcgtcatcccgttcatctccgaaccacacgccgccgaagtctcccagctggagcaccacatcctccttggtgagctcttggccctccgggaagtattccgggcggaaccgctcaaaattcccgtgggtgtcgcctgtagcgaagatcttcatgcaagcttcctcctttttggctgtgccacatactgctcgatctcccggccatcccggaaggtcacccggatcttctcccgggagagcaccgtcaccttctccagcagctggtggatgacctcctcgtcccactctgtcatcgccgccgtcatgtgttccatggcggccgacaccacccgcagacggttctggagccggccctgctcctggcaggccccctccagctgtgccttccgttctttgagacgggcggtggactcggacagcttccggaaccgctccgtgtagtcctctgccgggttggctgacgcctcggccagcaggctgttgaaacggctgctcagttcctccagggcccggtcaatgtccgccaggctcatgctctcacccaacatcggagcaagctcccactccatgacggcggtgagctgccgggcctgggtgtcgcgatccagcatgatggcgttgacggcggccaggatggcctgctggagcggttcctcgtccagggtgggagactgggtgcagaacttcttcccgtagtccaggcggctgacacaccgccatacggggcgcttgactccgcgctgggtccacacgcaccgccggtaggccgtcccgcactccccgcagaacagcaggttgctgaggacatgcttaccgctgtacttcccccggccggtgggggtgctctttcgcgtggcgcccgccttggcgttccgccgggccatctccagctggacggcgtcgaagatctcccggctgacgatgccctcatggtggttttgaatcaggtatttggggagctgtccggtgttggggatcaccttcttgctgatgcagtcctggatgaaggtcttctggagcaggacgtccccgcagtatttctcgttggtcaggatgctcctgatatgggagcccatccactctacttttccggagaccgtgggaattctctggccctccagggccactttgatctcccggatgctgtccccggccaagtagcggtcatagatgaagcggacggtctccgcctgctccggcacaatcctgggcttgccatccgggcccttctcatagcccagcagctgcttgtactgcatggcgacatggccggatttcatggcctgacgcttgccccagcgcacccggctgctggtgctctcgctctcggcctgggcgaaggccccgtgtagggtgatgaggaactcgctctccgggtagatggagttgatgttctgttcctcgaagatgactggtatacccaggctccgcagctcccgggtgaagttgagggtatccacggtattgcgggcgaagcgggagacggatttagccagaatcatgtcgatctttccctgcctgcactggcggatcatccgcaggaactccttccgcttacaggtggaggtgccggtgatgccctcgtccgcgaacaccccggccatggtccagcccggttccttcatgatcttctcggtatagtaggagagctggttttcataactggagagctgctcctcgctgtccgtagacacacggcagtaggcggccacccgcaagtggcgctttttctcctgttcctggggagtctccactttggctgggatgataatgacgttgggcgcagtatcgttcatgtaccttttcccccttccaaggtctggttatttttcagcaggacggtaaccgccccgttgctgacagtgatacggcggacgctctcgtggagcagttcctgctccaactccaccatgggagcccgctcctggaacagcatccggaggcctagggtttcatactcctccggcccgatggcgttcagctggaaggctgccaactgaaaggccaaacttttggcctgtgtctcatccaccggcgggcggtgcaggagctcgtccagcccccggcgcagattctctgtctccggcggcgatccagccaccggggccggacaggtgatacgctccggatgctggatcagtcggttcaggaggcccaacacctgccgctccacccatgccggtgggctgccgccgcacagtttccgcagttccttctgggccggcgtctttttgcagggggagaatttttcttgcctttgagcctgaaccatgttgaaccgggcctccgggatgatggacgggaatccaccttcgccggtgtaccggctgtccgctaggatacgggctgccatgttcttgttccagggcttgtccccgtcataggagatgcctctctcccggagcttgtctaccaaggcattgtagctggcaccggccaggtagctgtcgtagagccagcgcaccgtctccgcctctgccgggtggagcacgatttcgcccagctccattttgtagccgaagggccgtttccggttgctccccatcaccgcaccgtccgttctatgggctctgtcagctccaggccattgaccagccggaaccgcagacggtcattgctctccacgataatcttgtccacgagctcgcggaacagctccccatcgaaggcgtccaggaagtccggcccagcctccagggcttcgatcaactcctgggtctgctggatcgtctgatcttcctcggcctccaggaaccgttccttttccagcttcgcggcgcggagttgttccgccagctcgttttggcgggatataaaaatgtcagggccaacaagcccttgctgcttgagctgggccaacagtcgatcctgacgggtgatgtctgcaattttctggttgagtgccacgatgtccaggctccagagcagcttgcccttccgggcgttctggagatctgcgagcagttgggtgaggataggccctccctggtgacggagcttatagtacaggtggaacactgctgatactaccgcttcctcagcaatgggcaggaggtcgcacaactccgtggattcttcatgcccacgacatgccatgtaccatttcctgtttatacatttagggcgaagcgccttcccacagcagccacaatatagccagccattggcaaggggacgttggcctgcgattccgggcacctggctgtccccgcgcctccgacgcaattcctgtgctttattaaacacctcttgggaaatcgctgcctcgttaatcccttccacaaagtacatgggcttttggccatggttatactttattttgcgtggcagggtatccgtcgtataccgtttccgcagaaaggcgttgccgctgtaccgctcattggtgaggatgtagtcaatccgctgtggcttccagagttttcctttagagaacaggttcagcgccgctgcgatatcccccgccgtcttaccggacaggtacgcttcgtagatataccggatgattggcacctgctcggggatcagctccagcttccctttgaccaggcggtatccgaagggtgcggtgcaggtgttgtactttcccgccctcatcctcatgtcgatgctccaccggaggttgtctgagatgttttcgctctccttctggtccatcatggcgaagatggcggtaagaaactcaccggccaactctgaggtgtcgatgccctgctcctcgaagcatacccccacccctagggccttcagttcccggacggtctccaggcactccttggcgttccgggcgaaccgggaggaggacttcaccaggatcttgtccacccgaccccgccggcagtccgccagcagccgttggaagtcgtcccgcttttccgccgaggtgccggtgatacccttgtccgcgtacacgtccacaaactcccactccgggttgtcggtgatgagctccgtgtagtgggcgttctgggcggcaaaggagttgagctgatcctctgacctggagctcaccctggcgtaggccgccacacgcagcttgcgatccctgaccggggtgctgggcgcgatggtgattacccggggcgtgctgttcaatgccagggaaccactggttttcttttgctcgtccacgaaattgcctcctgtcagcaacacacaataccagcaccgccacaaaatatccatatccaaacgcaacaaaaatcagggggaaaatatgacgtccgccccggtctctacacggagccgggcggcgatcctcccggcctccttccgactaacaaggccggcgctctgaaggtggcgaaggagaattatcagcccgatataattgatattctggttcataaccaaccctcgtttcagagggaggccacccccaataggcagggagcggcctccgcttcctattttggatttccaaaggcaatcattccgcacctgtattcgacactactcccccaggtgtcagggcggcagcagacggactgcgctggcgcgcatcacgggaatctcacccctccgaggatctctccgagctgcccccattgcttgatcccggtatcacccggggctgtggctggacaggagtatcattatcagattgctgacgagggtcgggctgggtaaaccagccgcaatgcgaaacagcccgccacaggctgctttgtggacgtatgggcaccgctctgcaccttccttggccgtctttgatgcgggctcacggtccgcacaggtggtcttggcgcatcctccagcgtcgctttagccctccttacagaggggctctcatcagtggacgtatcccgctgccggatattctatttgcaaggatcaggacggaaatcggtagatcaccgatactcccaatacagggcaaactgtgccaggatgctgttcatgacctgaagatcatctccagacaaggttttacgaaccttcatcaataatacttgttgcttagaggatagtgtgcggctctccatgtgaaaccagtctggcaaatggatccctccaccaaaacgtccacgcacaacttggattggatagtagcacgagagaatcaccaggtctgcacggattgtccgctcggaaacgccaagttctgccgagagatttatggcggtctcatggcgccttttgcatagcagatgcagaatttcgcttctccgctctgacggggtcatctctctcaccgcctcgtcttgccctgtgattagaagtataaaggttaaagcggaagaccaatttccggtttaaaaatttttatgatctgataatgcaatttcggcattatgccagattaaaagccattcttttatgcaatatgacaggctcgtttggaatacaaagaaaactgcccatgtcggaagagccatatggccgttccaacatgggcagctcctgcctgtaaataaattcccgtcaaacggttatgcaaaagatctttgccgttgaactactatctctccaccattccatacttgacctttacgcggtccagcttctccagcatgggctctgccccaaaccagagaaaaagccaagtggcagccgcctggatacagtcgaaggggagtccggagatgtagtaggtcagcaggaccttttcattgagctctcccacccaggtgagggcggatgccggattcataattccgccgtagatcagtatggcggccagtgcgccaaacacgcatagtgcaccccggttgcgccgcagcagcccctttcggaacaggatgcctgccaggaagccgatgatccccatggaaaacatctgccagggggtcagtggcccctgcccgaagagcacgttggaggccagcatggtcattgcacccaccaggaagccagtttcaccaccgaaagccacgccggcgataatggtcaccgccatcaccggcttgaactgcggcagcatgaaaagcgccgcccgccctgcaattccaatggcacacagaaccgctatgatcaccagttccctggcctgcggcttccggccctcaaaaatcaggaaaaaggggagcatacactccagcagaaccagtagagagataaagtaatacttcttattgtccagataaaacacaccgatatacagggtcagagggatcatcagcagcactagtacagccgccacaacggttcgcttggccagcttccgcttggccttgggtacctgtaaggcataatcctttcggtgggatctccgggtgatgcaggtagcaaacagaaagagcgagagaataaagagtgcgtatagaatcatttgatggtttgccagttctgtcatgccgtcggcagtaatcagttgggtcagatccgtaacgttcataaacgacaggaacaggaggaaagacaccgttcctgtcagcactgcccccagcttgcgccaccagggcagcggtttaggcttgtagtctgcgctggcttcctctggttccgggagcggctccccgctgtccggaagctctggcgccggcggtagatttcccccgcatgcctgtatgacgtcctccgcagttaccgcctccggaagcaggccgcgggccatgcggttggctgaggtggtatagaagctattaccggagaaaaaggcccgcggtggggcttccgtcacaatggagccgtcaaaaaacagagcgcaacggtgggcataccgggcgcagaactcaatgtcgtggctgaccatgagcagggtcacaccctgacgcaagaggctttgcaggatctcggcaaacacctgcttgaactctgcatccagccccttggtcggctcatccatcaacaggatctccggccccagcaggagcacttttgccagagccgcccgctgctgttcaccgccggacagatcataggggtgccgatccagtaatccctccaggcggcacagccgcaccgcccaggccacccgctcctcctgcgccttccccgagaaattccggcccttgagaatctcaaagagatcctctcgaacggttttcttcacaaaaagcgcctggggattctgcggcaacacgcccacgctccccgccagcctcacctcgcctcggtagggcttctggagtccggacaacagcttcaggctggtggtctttcccgttccgttgccgcccagcagggccagaaactcgccccgcctcacggtgaggctcaaccccttcaccacgtccggcagctctttttcgtatttgaaccacaggccttccgccgtgatggccggttcattcggatatgtgcggcgcggctcagacggcagctccatcagggggtgtccatccgcgaacttcgtcagccaatcccggccctcccgcaccgtgaccgggcagtgtccgcccgcatccggcgcggatgcccagatccgcatcggggttggcatggccaggaacattgagtgtcccgccccgcgcaggatcgcccccacctccgcgggactccctgtgcagagcagccgcccgcggtccatgaccgccacacggctggccaacaggaaggcgtcctccagccggtgctccgtcaacacgaccgtcgtccccagctcccggttgattttccccagcgtcgccaaaaagtctgccgctgcaatgggatcaagctgactggtcggttcgtccagaatgagcacactgggctgcatcgccatgatagacgccaaattcaggagctgtttctgcccgccggacagctctgtgacattcttgtagaaccatgtctgaatgccgaaaaaggaggccatctcggccacccggcgccggatggtgggcgtatcatatcccaggctctccaagccgaaggccagctcatgccacaccttgtcggtgacaatctggttctccgggctctgctgcacaaagccgattcttgcgctctgctcgcgctgatccagctcctccagcggccgtccctcaaagcggatgtgacccatccggcggccatggggggccagtacggtcttgagctgacgcagcaacgtggatttcccacagcctgacgggccgcacaacaccaggaattccccccgctccacggtcagcgttaaatcgtccagcgtcttctccgcctgctccgggtaatagaaggaaaagtgttcaatttcaatacttggcttcttctgctcagacacgcatccgtcctccctgctgtaataatcttgtctgtacgctcacggcctccgcccgggccatgcgcccgcgagaggacagctcgtgggtcaggtagcgcggttcaatctgctccagaactgacaggatggcggggtctgtccaggggcgatgctgatcaatctggaggatgtgctgatagctcactccaaaccgctccatatagtcctccggcagccccgctggcagtgaaccagtgtgcgccttcacataggccccactcagggactggtgtagatggacgccccgcacccactttgccaggctgccatgccggttcagcatacgccggatgtagtctgctccctctgcctcagttttcaactcagtacaagcattcatcagatgtccggtgtccagcagaatccctttccccgcaaagcggattccctccagcagccgggccgtctcctccggttccgtaaaggtaaagcctggccaccactgattttccaccaggaattcaaacggccatctctcctcgccaagaatgaggttcaccacctctaccgccgcgtcaatgacctcctggttggtgtgcagccagcggtaggtatatccctcctccagcgatacgtccgacacatggaagaccacataacgggcgcccaggttcaccgcccgccgtaaatccgcgcggtattgctccagcagcgtatctggccccagcccgccatagaagctggccgtaacctccagtgagccgaatttttgtttcagtgccgcccggtcatctcgatagaagtccagccagtccgggtaaaaaatcaggtggtacccaagaataagctcggcaggcaaatcctttggcagatcctctccgccccagacgccctcgatgccgtcgcagcccagccgttccaattcctggcctagatcacgccaactgttgtactccccaagagtcccggagtacagaggcaggctcatcatttgatacatggcttcacctcatttcgggcgtccagtctgctccaggtacggtccgcgtggatattcaggaacaccggcgtcaggcataatgccaaatagaccgcctgtaggcagactgtcagcggcgccgcaggcgctcccttggccgtcgggtagtatctccaggaaaagccgcccaccgccgctccgcagcagaggaagaacccgcaatagagcagccatcccagcgccatcttgtcccggtcatcaaagcggtaaatggagaaggccgtccgccccggaagcccatacccccggctcttcatgctgtcagctgtctcaattgcattttccaggctccaggtaagcatgatggagaaaatcgtgacagcgtttcgaatccgccggataaccccaccatcggagacatcccgtccgatgcatcgctgcgcctccgacacaacgtggaattgggcctggaactttgggacaaaccgcagtgccatgctcagcaccagcgagagagccggtatgagccttccaaacaggtagacaaatttgtccgaggtcatcaccgctgtgtaacaggaaaaccatgtcaccactgcggccagcatggctgccgccgctaatccatacaggatactctccaatgtgagcggatttcccgaaggcaggtatgtaagcagggtcgccccctcatggttgaaggccgggttgatcagggcggccatcgccatcatggggagcataaagacaagcgagaagcgtatcgccttccgccccctcagatagaccgcataggccagcgccgacccaagggaaatgccgaggctgaccgggtgcatgaaaaacattgtaaaggctatcaccattccaaaatacagaaaatttattattgggtgatagctggaaaaggtatctctatttcggataaggcatcccctctaaacaccgggtacggcagtcagccgtacccggtgtgcatttctgttgcgaggcattcccggtatgcacgctactcggcctactctgcccgcggctcctgttcatgcctcgctatctcgccggcaatctcttgaaagcggccagcaagatagccatagttgtccctttggtgcggtatcaggcatttgctgcaatccttaacgccgttctccaaatggtgaagcatctccgcacgttctgcccagcatatacatcggacgatagcggaacaggcggctgagttccatcccttccgcatggagcggcagggatagcgttcccacgccttattggaggagaaagaaaacgtcctgccttcccggtattgcagttgctacactccctgcagtagtgcaggaatcgtcccgcaaccacgcactcgttcagataggttcttacaggaacggcaactgcatttgcctctaccgtatacggcatgagcattatccctctgaaagaatttcagatcactctccagtcgaataaaaaccgcccacatccacacccaggtcgcaggtgtagacccactctattacatccccctctttgagctgatagcgtgagcagccataattggggaaccacccgttcactttatacatccagccggacagctcgccgcagtcaaactcatagaggttgttaatcccctcaatataagcggagttatacatgggggtgtcctcgaactccatgtggatgccagccttccgcatctcgcgctggagcacattgaacacactctccccctcgtagaacgtaacagtcgtcgtagggaatatgactccgtcttccggtaccagctccaccttctctggatccagccagtccatgttgtccagaatggtgtcacagcggacagagagcgtacaggtatgggtcacatcggagaactccacatcctgcggctccaccggcagaggctttccttccggcactggatccgtaagatacttgtcctttccagtctccggattgatctccatgccgttggcctctgagtacgccttgtcgcccttttccacaccggcggaggagccgcccgccagctcggccgcggcctccaccttctcccgggcagtcatgccgccctccgcaccgcccgggcgggcatccagcccaccgggtgttggggatggcgcaagggcatcagtctcctggggggtctcggacggcaccggactaccgctcaccgtcggcggggggctttccgcctccccgccaggtgtcacgataggcgctatggattcctccggaccggaggcgggcggcgcggcctccagcactgcgctgctctcctgctcctgcaccgtccagccctgaagacctggcgcgttgccgccataccagaacgcccctgccaggaccgcgatcacggccacagcggcaatgattttcccttttgtcagcttcattcggccgcctcactgtcttcccacggcgtgtacaggcagtaggccgggcacaggtcgcccatatagatccacacgttctctcccatgtcgacgggctcggagaatgtcagattggggatcatcagcttgagagtggtgcgcttacggcccttgatattttccccttcaggtgagggctccttccggaacgcctccacccgctgggccaggtcgttgatgcccagctcccgggagagctttggaagtatctcctcctccttacagtaagccacatgatccggattcttgaaccaagctacgttcatcatactgtttcgtcccctttctgtaatcgtcagagcagctcagcgctactcagaaggttgaaaagcatctgagcaacctctgctcgggtcacagcgtcctggggccggacgttcaactccgtttggctcaggatcccctcctggtagcagaaggccagctgggccctggcccactccgcggagctcatatagtccgggaactgcgccagcatattccgcacagctgcggtatccatctccgtctcgagtccgcacagctccgccgcgcgggacaccatgacggccgcctcctgccgggtgatagtcccgtccgggctgaaccggccctcgcccacgccgttgataaggccgtatgtgctggccgcgcccacatagggggaataccaggcagtggaggccacgtccacgaaggcgccggtgtccgctggtgtcagccccagggcccgtaccacgatggttgcaaactctgcccgggtcatgcttccatccgggtcaaaatttccgtcggacttgccgtcaatgatgcctcgggcggccaaggcctcgatggcggtgatctggtcactgaaggcgatgtccgggaaggtcttacccggtgacgtgataggctgggcggtcacggcgggatccttgccctccaagccctgtccctgcccgctcatctctgtctccacggcgtcggggatggagagggcgtcggacatgcggtagaggctgctgcgcccctccgccgcccgctgggcggccaccaggccgtagaagccctgctccgtcgccatctggttggacccggagccggactgggtgtgcaggaagccctccccctgccggtagaaggtcatcaaattgtccagcatggtgtttccgttctttacaaaccgaggatcatccagttcgatgcccagctcacacagagccacgatcatctgcacacaactctcggagttagccgtcccccaggacgcaaaaccgccatcgtcgctctgctgttccgacatgcacgtcagtgcttccttagtagcccgcgctacctccggctgatcttgatacttggccagtgcctgcagagccataccggtgatgtctggatcggatattccatcgccagaactggctgcctctgttcctccgaacaggctccaccctccatcgggcagctggcactccaaaatgcggtcgatatacatttgacgggtcgcctgtacatttgcctccgggttctccggcatgggatagcctgcgctatccagtgcaatcaacgcccaaattgggccgttaagcccctgccaaatcgttttttcgtagtcgcccagcggtttggtcaggtcatatccagccacatttctggcatctttcccgattgagctgagagcaactatcacacgggaatactccgtatatttcttatcgtgcagcttgccgtcgcaggccgttacataggcctccacagtggcatagtagtcctgataatagctgtccggtacatcgtacccacttcgggccagccccagcacagcccattcaccgccgatagaccctacctgcgggttctgaacggtgcggtacatatattctgcggtatcctgcaccgcctcgttcaaggtctctttggatacggccgcctgcgctcccgtcaacatacccgtggtcagggacagggcaagcacaaatgcgaatccacgctgtttccatttcttcatatgaccgcgtctcctcctgtttttctttcggaaggccctgcaggttccctccaggcactgagccaatagctccacaaatgcttcatggccagcttgctaaggacaggtatgcccatcagctccatggcccttttattggtacatcgctttttttgaaacagcttcttaagctctggtgtgatttcttcttctcccggcggccgccagctttctttgacagacttgcacatgcgttctaccagttctgactcccgctccgtcaagggagaaccaatccgttcgcaatacgccctgaatctgtctgcggacacccgctccggccagtctggcggccaccgcttttgctcttccagcctttttcgaaatcctttggctgcccagcacgctttattggtacttccaaagcgccgtttcaaataaacctgacgtattaggctgagctgatacagccgtggcttatggcctggatgatccattgtcccaaccacggcctccaaaagcgcctcatccgtatagctctcataaatctgccggccgatattcccttcgggattaaatacccgccagatgtccggatccaccgtttgtcttgaactttcttgttcttcccggctttccacgtccagttctgagagccactggcggtatccccgcagctctttttccgtcagcttttgctctttgagcatgataccgctcacctcaacaagtaaaaggcacgccctccccttgggtgagcgtgccttacatttgtatatcccacccatttcttcacaatcaggtcttgccgactagacggcgggggcaggcccgtaccggtttcccggagtttcacctgactgcatctctgtttaattgtgggctgggccgcccggcagaccaaattcggtctgccgggctcctgctcaagtaagaaggtgctccctccatccttactgggtggatagggggagcacccatgcggctcggcctgggtttacagaccggagccgaacgggggtttcatagtttcttccggcatctcaggcgttctttgccttactctccagaaggcgcatcaaaatggtggcaacctcagcgcggctggcctggccctgcgggtctaaacactttccatcctttccggtaatcagcttctccgcataggcccactccatagcccgggttgcccaagcggaggtatccgtaccgtcggcaaaatcctgcagattggccgttttgcttacatcccagcccttgagcttcgcatagcgatacaggatggaggcaatctgctcacgggtcacgctgccctccgggtcaaagcccgcacctgtgccgctgacgatatcagtctggctggcccaatccacagcctcggtgtaccacgcatccggcttcacatccgggaaaccggatgtgccagccgccgcaggcacgccctccagccgccacagcgccgtaaccagcatggcgcgggtcatggtgccgttgggagagaaggtggtggcgctggtgccgttaaagagctcgttggtataggcataggccactgcgtcgtagaaccagtctccctcacgcacgtcggtgaaggggagctgcaccggctgttccggcggtactgcaacaaaggtgcccaattgggtcgtgctgacctttacccaaagcccgccgttccggctcaggcagacgccagccaacttctctaccgcgccgcctccgctgatctggtatacggtgcaggcctggcccgcctggaatgcaccggcattcacgggcagaagcagggtaatggaccggccgccaaagctggtgatggacttgttgccggaggtaagggacacctccaccacagaggcaccgctcatctgctcttccgtaacgtccgccctgccgttcagcagagcctctgcctgggagatggtgcgccgtgccatattgacggtcagatccttcccgcctgccccactcaggattctggcaagggtgagatttggcatggacagctcgcccagcggcgtccgtacagccagatccgcgttcgtctcgtcaagggcgttgtccagggtgcatcggggcaattccacagagatagcggacgcctgttccgcccccgtcggggcgatgaccagcacgctggcctcggcctcgagagcctcgtccaggagcttgttgagatccgccgcagtcactgccgcagaagcgtttccgctattatccacagacgctttgggctccaggacaacttcaacgccgtcctgctctggcagtgtcaggctaccgtcaatgacaggcagctcattctgcccgaccgcaccggactctatcagccacagccgcagggcctcataccgccctgcgtcctctgctgtaatgtactcccgctgcttgctgttcagcttctcatatgcgtctgcggctttccgcacctgacggatcaggctactggtcgggactttgttcttgttaaccgccggcagctcctttaggagctttttggctgcgtcgatcttctcatagaactcgattttctcctcggcggcctccagcttattcaagagggtctggctgatctcagccttcgccttttgggtcagcgcgtcataggccgcccgcgccgccgacaccttagatgcctgggtcttgtagttggcataggtaatctccggcactgccttgatcatcccaatgaccgcttccgcgctgttgccgttcaccacggtaatggtatacttggtaccctcgtagtcaatggcctccgtgctctggttgttcatagaaggccacgatgggtcgcctacgccgatgtaaaggatgtcgccgggcttgactgtgatgctctccgtgcgcttgtagaaggcagagtcgcggttgtagcggttcaggaaggtcttaaccatgtagttcttgttgaccgcggtgggcgtcacggtgacccgcgcactgttcccggtaatgctcagggtatactccaaggtatcgccgtcaaaacggggggcgagactcccgccgctaatgtgcaggtcctccagactagtgtccgaattgccccagagactccccacatcttcgcccaggttctgggtgaacacgatgttcaggtagtcgccgtctgccagctcgtaggtgccgcggcctccgacccggaaggactggaaaccttcgttgacaaaccagtcgttgagggtgcccatccagccggcaccccgggaaccgtcgaactcggccaagctgggctcgctgttgtcccgccggccatttccgtttttatccatatagatgccggacaggtaggtgatatcatagcctccggtatcgctggccccggtaccccaccaggagtagccgtccagggccagggccttgagtacgatggtcatcatggtgtcctcggcgcacaagtcataccagccagacgccagggtgccggtgaagtctccgccccagtaggtgttattctcaatgctgatatacacctcgcctaccacggggccaaagtccgggatctccgtgccacgctggaaggtggcgcggatgctgtggctcgcatccacatcgtagaaggtataggaagcgcttccgtccgaacggatgtacagctcgtccagatcgaccgtctttccgtctacgcgcagagtggcgatctcgtaaccgttgtccggcgtgatgtggaagatctgatcttcgccggcatccacttcgacagagccaaacggatcaatatctccattgccgccagccgtcgccgtgatggtaaaggtctgcgctgtggtctctgccaggacgatgaaggtgctcaggtggttcacgctgatgctgaccacccggccactgtcagaaacgcggcatgtgccggtaagaatctcatggctaccgttatcgctgataaccagcactttgtactctctactcagggtaaagctgttgtccacggggatggtgagggtaaggtcgtgaccaccgaaagaggtaagttctgtgctgcccaccctgaccgacacttccaccgccacgctaccggcgaggttcgtcccatcgggaactatgtcctccattgcgctgtgactcttctcctccacatggatggacagcttctccccgtcagtctctttttgggcaatggagcccaggacatttgcggggagggtgacggttcccctggacgtctggatctccacaccggcattggcctccgagatggtctgggccgcgcccgcgggcagttccacgctgaccgaggaaatgctgctgctgtccgccgtgggaatgatggtgatggtatccgccgctgatgcagtcaccgcttctaccgctttctgcaccgccgcttcgtcgatgaccgcggtctgagtattgccatttattgtcacctcctgcacgatcacaggggagggcttctcaaaggtgacggatatggcgtggtcctcggtgacgttctcaaaggtgtaggtgtaggatttgctgtccgcgctggtgaccagggcgttggcggctgtggtcggggcggcagattccgcctccgtccgctccgcgccgcagtccgggcacacatagacggaaattgtctccgtggaggccgccgcgtccagctcccagctgtggggggccagagaggacagctcctccaggccgcaggcggcgcatacgttccagtgcaccccgctgctgtgggctgtctctgtgaaggcgtgctgtgcgtaatcgccataggactggccgcagaggtcgcagctcgccagggccgtgcaggtggctgtgccgccgctgtggctgcacgccgccgtgccgcccgtctccgggctgtagccgcacacctggcaggcgctcccctctgcatggggctccgctgtcccgtccgtctggggcagaccggcgcccacgctcatcaggagcatcgggtggattcccacaacactgaccagttccccgcccgtgctgccggggtttatatccggctggctctcatcactggccggggcttcggcggattccggaattttggtctgctcctctgccgggggctcgttttcgttggcagagtcttctccggtttcctctccgggggcaggtacttcaggatcggattctccttctggaggaattgtgtcgggatcttgcccctcggtctcctccggctgttgtccgtcggcatcgggcatctccggttcggccccgggcgcttcggtttcctcgccggtagtgggtttctgagtggcgcctccctgctccgggaactccagctccggtggagcgggctcctccgtctgctcgaacacatggggttctgcgctacttttggcgccgcagatctggcacacctgccaatggctcgtctcgtccatctgccacgcgccgccgtactgatgcggaaccgttctggtttccgcgccctgctccagcacttcgccgcaggcaccgcagatcgtatctccagtgtatccaggctctgtgcaggtggccgctcgctggccgatgacgacgttctcacccacatggatgccgtcggcgcaggcctccggctccacgtcctcaacgggaactgtgggtagctggtattcgggcggttctagtttctgcgccacggttgcaccgccggcccagacggatttcccgtccacgaggatgtcctcaatctggtagccctcgtttggcgtgacggtaaaggactgcttcgccccatccggcaccgtgacatcaccgacgggagagatggtgccaccggcatctgccgaggcgtggatggtgtggtcggtatcagtaccgtccgtcggaccgtcaaacacgtcgctcatgtcatagaggggtttcttgttgttcttgtagcggtcgtaagccaccagggcataggctgcctgctcggtggacatttggtcgatgggaccatcagaggtgtggctgaatccgccatccgtcttccggtagcccagcaggtccgccagaacgctgatgctgcccttggcaaagctccccgcatccttcttgagcgcagctagggccacaatgacctgcgcgctggactccgaactgccgtatccgccggtgctgttctgcgaggtggacaggaaatccaaagctttttttacagcgctctgcagatcttcatggctgtgcgctgtgcccagacggttgaactcacctgcgtcgagatagtagggtgcaagcgcctggagtgccatggcgcagacgtccacgccgcccagttggcttccggagccgtcattctcctggtccgggttatagatgggccagttgccgttggactgctgcttgtcaatcagcaggtcaatccatgcggcccgggccgtgttgcccgcttcatcccggtaataatcgccggaattcaaggcaatgagagcccagatggtgccgttgttgccctgctcagagacctgataggtgtagctgctgccttcggcggcctcgtccagcaacggcttcaccagattgtaggttttaccgtcactgacctggaactgtgtggcgtccatgcccaaagcggttagggttactacgacacgggcgtactctgtgtgcatggttccattcttggaggtgtccagtatgccgtcatgggtctccacataatccgccaggttggccagatatgccgcccggacgtcttcggacagggtgccggcccgggcctgggccaggacggcccactcgccttttgtggagccgacaatcggatttttgacgttctgctccaaatattccagaacgccgttcatgacctcccggtagccggaggtgtcctgtccgccgccctggaggatctccagcgcggcctcggcagcctccaacacgttcaggttggacaccatgtccttgccgctgaacttgccggcatagtccgtgtacgcctgccgggcagcggtgatggccgcctcgctctccagcgtaaccgtgccgattccggcgatccgttctaccacaggcagggcggcctccgcattgaggagggtgttgtaggaatccggcgcggttgcaaccagggctttttgcgcatccgtcaggttctcatatgccgtcctggcggctacaatggcatccttgctcccggcgctgactttttccccaatcgcttccaccagatcgttaaacgcctgtactgcggccacgtcgtccggcgatatgctcccgcccagggcctccaccgcctcgttgagacgggcgacctccgctgccttcagataaagttggccgctgatacccaatgcctcgtaagccgtttttgcagcttcaacttttgaacggtgcgcctcaggattctccgtaatttctacggcagtgggaaggtcggcgatctgagtttttacgctgtcaatagccgcaaagaactggatctgctccgccgctgctgtcagtttagcagcagaaacctgtgatttgtccggcagtgcattataatccgcttgtagcgcactgaccgtctgttggaagcttttatagttgctatatgtgatttctgacttatccggcaggtcgtcgatcctggcctggattcccttcgctccgctctcgcagacctggatggtgtaccaggtgccggtatagcggagcgtgttgccggactggttgttcatggacggccacttgtattcgcccacaccgatgtaaatggtgtctcctggctggaccggtagattttcaccacggcgatagtactccacattgttggccgtggttttgttattgataaatgtcttgaccaggaaatttttgtttgccgctgtaggtgtgaccgacacatctccgccgtccagggtcagggcataactggtggtctccccgtcgaaggatggcgacagcgtaccgccggtgacctctagttccttgaggctggtgtctccgttgccccaggttccgcccagatcgtctccgtacccgtccatcgtgaacatcacgcggatctcgtctccgtcaaccaggcggtaatcgcgatccgtatttgaaacagcataggaagaaaatccgtagttggtgaaccaatcgttgagcacgcccatccagccggaactcacactgccgtcaaatgccgcaagtttggcttcgccattgtcccactgcccattctgatttacatctttatagatgttttcgatgtaagtgacgctcgtgtcattcccgttgttccaaccataaccgttctcggacagggcttccaacacagcagtcatcatagtggtatcactgtaaagctcgacctccgcctctacaaaggcgccgccattttgatagaaagagccgtccgcgtaagtggtgttctcaacggtcacatgcacactgccgaactctccgctggaaacgcgcgtctcaacggctttcatcgcattgagggcatcgctcaaggctgtttctattgcttcggcgttctccgccgcattgatcttggacacgccctcgtcatacgcagatgtcagtgtcttccagtttgtatcgctgtaatcagaccgcttatagccattgaacgcctctgacagttgatccagcgcactgctgcgcagactttccaccgatgttttgcctcggatataaaatgtgatcgtcacatcgttcctcggcatgaacgctgatgtggagtcagcgaagtagaaaggggcaaccccttcccaacccttgttgtatccgcctttcggatcggttgggggcctatccagcctcaattcgctcagtgtcgcccccgtggactccacacgatagatctcatagtccagttcattcaatgcagtgccggtttccgtacggatatatacccaccactcatcattgggcgagagttcaatgacgttcgcatatcgaaagcctttgtttttaagggccaaaaagctcttgaatgggtcactggatccctcctgcccaatgaactcaaaggtcagcgtaaaggtcttttccggcaggttgcttccgtcctcaccataggcttctaccagagcctcccactgtgcctgttcctggccggtgagctgtgatttctggtagccggtcattccggcatagtgggaactcgcctcctgcatggtggagatgtcgctctgcaggaagagtccctccccgatctgtgccactgttgggagcttcgccaggtatttccgcatggcagagacagattcctcattggatttctccgcgttctccaccaggctctcgatttgggtcagcgcatttgagagcgcgtcttcggccgctttaaggcttgtcgcgtcctcgatggcctgcactcccgcatcatgggccgcctggacctgggcgtagacggcttctcccaactcagtggcgttgcatccggccagcgccgcagccagaaggctcttgcgcgcctccttcgccgccgcaagttcttcctcattcagaggggtgaccgtcactgtggtccgggcgggcgcgttcagcgatgcgtactggtgctgggcgccgctggccgtctggtcaaatatcacggattccggattcgccgcaaccagcacatattggcccgcctcattgagatgcgtggtcaccgtcccgcttgcgtcggtgatcccctccagaagctggtactccccggacggcgctccgctctcatccagcttcactgccagcaggcgggcgccgttgaacggcgcagagcggccgtcgtagcttcccacccagcctccagttcgggtcaccttcagcgtaagcgcctcgccctctgccacggtctccgcatggtcttcaaacgacagcaggccccagaagtctgtcgtattggcatatgccgttacgcccatggcgctgtattccctgtccatgggtgcgggggcgaacaggatcacgacctcatcgccgtcccggagctttatgtcgctccactccgttcgatccacagttactccgctcagcagggtcggatttaatcccgcatcccggagctgaacgccgttgatgaagattgcaatcgtggtttggcggtttgacgtgggcgaggtattgttttttacctgcagctggagaccggctgactctatcaatccggcaacggtgcggttcccaccgctcagagcgatagcagggctctcatagacgccctcttcgggcgcaagtcccagctccgctccgtccgggctggtgaggtcgtaggcaacctggctgtcggccacgcagagggagacagaaattgtttccttcgcgctctccagcccctcgtagtaggccgaccacagcgccgccgcatgtctctgatatccattcaggacagaagcggacaccgacgtccctaccagaccgtgctgccgatagtaggattgggcttcctggtaggccgtccggaacgcggtaaagctctcctctgtatagccgctctcatgttccaaagcgcccgcgaactgagcgagcataccggcaagcgaccgctgatagatcgacgcgctggtcacctcatcgccgccgttgtaaacagcgtccagaccgccggcggcagccagcaactcctccgcgtactgctccacagtgtcctgatgctcagccttgttctccgttgtagggttcccatcctggtcatagagggaagcgaggtaagctttgcccttctcatagactgtcttatacgcagtccaggtctccggcgtatagtcctcctgccggtaccctcggctttccacctcctggatggcttcatacaggacagtggcgttgacctggttagcagggatcaggttggcgatggccgcattcaatgaagctgtggcaccattcacatcctcctgtgttgcagttatattatctaaaatctcctttgctgtttttagtgccgtctgaaagtcctgccaaaagccgtcactgctcgttgtcttcccgttgtaataatcctcagcctgatagtaatcactactacttattaagccagccctagcaatgacacgttgaagctcatctttatttgctccttcgacttcttgcgatgcctctggccattccaaaataaggacaccaattatggtattaattttaccccgtttaacagtatataggtagtatccaagcttgtctgtgtctgttcttagtccatctaaaatttcttcagacagattggatgaaatactgctttgataaagggcctcacctttcgagtaattttccgaatcaggtgccacgttaatcaagtttgtcgcacctatagctgctggtttcttacccataactggcacgacagtcgtaattgcgcagcttgacgcatccgaaaactcaatcgcattatattgcacagtatctactacaaggcggtataaattataatcatttccttcaattgttatagttccaatttgctccaaagcatctgggtccgatacggtcatggtctcggcggcaaaagcagttgtcggtaaaaacccaagcaggattgtcaaaatcaaaataaatgagatgagcgagcgtccaaaaggacgctcgctcacttttcctattttatccatatccattttttattggcaaatcagcacagtaatatacggggcctcttctccggtctgcgtgatgatctgtaacatgtctccggctgccattgtaaacacatgcccatccgcagcatcgctaatcgtctcgccattgagcaacacacgctccatatcggagtacagacggtacttgccagcggccactacctggctccccccgttgctcgtattcacctcgttctctcctgtcgctgcatcggcaataaacagatcctccgtgatgctggcagagccgctccctgtcaccgcgtagatgccgcaaacctcagcggaggtctcaccgaagataccgggtgtggggatggtggtgttatccgtgctgctcatcagtgcggatgtatatacccggatataaccgatccttataagccccgcaggtgtgccgtccggctttaccgcccacgcaatgtcgaagccatccccaccctgcgtggtggccgcggcggtgtagggattgatcgccgtaccataattgccgccattcacatggatatccgcatagccaaactgatagtccgcggtggtatccgtgtcctttaccagtgtaacgccggtataagtcacgctggcgccgttaaaggcggaagcgccgacggtctgatcgctggagacggcggacgtcttccacacgccgccgtagttcgccgtggtggggaaccacgcagcggcgccagccttgaacgtcccggtgagtgggaaggaaacgccgggattgcgcccgttcggatccgtgatgctgtactgaatatcgctcccgctcagggtataggtgatgttcacatcgcgaagcgtattggggtcatagtacaaacttccggccagctcataccaggtctttccatcttcggagacctggacagaggccgcctcagggttgccgttgaaggcgttgccgtagacgataaagtccacgccatagggattgctcgcgtcatcttcaatataggcctggttcccttcgctgtcccgcagggcatactggacgtagccgccgccggcacccaaggagacgccggtagaagagaacccgcctagaaccttgggggtgctgccggccgtcgtgctgccgtcggtataagggctgccccacatcgtgccccgggcatactggcccagcggcagatacccctgcaagactccggtgatggcgccgccggccatctgtccctccggcgcagcaaaggtcagcgtgtagacgttgttgctctgggccgcattcgccagcctaatcacaatgctgcccccgctgttgttggtcaccaaatacttggtgccgccctccgtttcctccacaggcgcagacagggtgccgccagtaacggtgattccgttctcctcggcgctgtctacatagaggtagaagctggagggatagtagccgtcttcactcgacacgatatctcctgtgtgataagcttcggaatctacggtttcactatcccataccaccgacaaagggcctgcagtatcaacgctgatgcggtcatggtcattgtccattaccgctcccgcactgaccgtcagcaagctgaatgccatagccagggtcagcagcatcgctgtaaattttctggttttcatacgtaaacctccttcaagtctctccgttggatcgtttcccttgtactcctgtttacaactctttttgactctcaccgcctccttccgctgagaagtcgcattttaatcaaccgtcaatgcggccgccgccgcgctcccggaaaaagcgcaggggccgccgcaccgattgtcccgttcccgctgatcctctccgcccaaacaccaatactgttcctgtgcagttgccgccccgcattgctccacgtctctccgctgttggtggctcggccggccttgccggcgtcctggcctactccgctcacggaatatcgcttttggtactgggttattcaattgtcagccgcgtaccggccatatgcgacaggcgatagcccgctgaatgctcaaagagagatcgtcataggggtttccctatgacggaagaaggggatccccttcttcctccggattgctcgctgctgttctgttgctctgtgcactcccgctctccgcctggcaacggaactcctccttgaaaatctgccgcttggaggtgggcttctgcttcttcggcgagggcagtcctgctgacgtgatcacattctgccagccgccaaagcgcgccgcctcgctccggacataatccagcagcgcttcgtcgctggcgtcaccatgcgcctgggcaaactggacgtttcgctgacgaagcgcctccttggtccgcccaatgagctttctgctgagctgctggttgccgatgaaatgcttaccgttcacaaaacagcctcctgacttgtggcacaatccggctaccccgcaaacctcttggggcaatcgaaacaaaaagacggacgcataccgatacgtccgtctttctcccgagcttgcgaataaaaaacggacgcaaaatatgcgtccgcttctgctcccatttcgggtagaaggggccacttattcagtgccctcctcacatttggcatttatctcagagcaaccccaatgaattgggggtaagctcctagtaggtcttctgactaatgtgtcccgacgggcttaaagcccgcctgcgcatatccgccgccttcccagctaagccattacgaccgccagtgacctgctttcgcagaaaacagatatactccacaatcacagctattgaattgcacgtccccgtagctttcgccacggctcctgctgcaaaacatgtccaggaatttcacctgattcccttgttcagaaacaaggatgcgtgtccgctccctgacgggagtcgggtcgcgcatttgccacaaaagccggattcatattaaattttacaggaaggtgcatgccactctgcccatgcagaactcagaagccatccccttcaaagaactatcttttgttaaacttgcactttacaaatggctttcttttgagttcattatacaactttccgcttaaaatgcaaggggtaaacaggaaaatttttcaaacactatttcgcgatcctgataatcgccttttcgccgagcgctgcggtataataaaaagcacatggcccacccctgcgccgggttcaggccatgtgcttctcttgttccggctggaagaacacataatattacccacgatattatgcgcccttttcttccagccgattgctccaaaatgacgcgagacctgcagaagagtcccgtgtcccgtgtggagcagcacgaaataggagggacaagtgaattcggcaacaaaaaaactgtatcctgaaggatacagcaacaaattccacaggttcctactgtggttgaaactgcaccctcccaggtccggggaggcttttttgtgcgttatacacaggcaggtcttctgactcagacgttcaaacgcacctctccgtcttcccggaacaaacatcccagtgacatagcagagaggcactccgccaacacagcaacggctttgtgcgggattctcacccggcttcccttttcacccaccacaattggatggacacctgtgtaccaactatattcacttgtttttttattttatcagggtgcactcggaatgtcaagatggaacaaaagaaagtatgtgtaacaaaatcgttggcaaggggtgctggtaccaaaattggagccagtagaaagtgttgttcaaggtgaatggcctcggcgtaaaccgggccaagcgcactcagccagcacagtcattctgtggtgtgcatctcggacagcgggaagaatttggtcaggcaatacttcgcggctggatggaggtcaccagcagacagtaaatgcggtgggatatagatttcactcatctgtttgttggtttgctttgcagatatgggagccgttattgtgtatagcttagagggggccccgtgggccgtccaatcccgcagaacacgccgcagatggccggtgcggtgcaaggcgagcaaagccgcaaggttgttggccccggccacgctccagcaggtgcggttgtgcttcatccggttcccaataatggtaaagatgttgctctccatgctcccacaccgggcgggctgctggccctcgttgggcagcgggggttttcttccactccgttggtagtatggaataagggatttccggtagttgttgaagtaggtaaacagcttccgccgcttctcttgttcgtcgggatccagtgtgctctcaatagatgcctccaccacagcaatcgcttctttgactttacgtgcatgaaatagctccaggatggtttcctggaggtctgggtcattcacacaggtacgcacagcccggttccggtggaacaaatcgagctggtaggtacatccaggcaccatattccgttgcagccaggttccgccgtcgctgttaaagacccgtcgcttcacgcagtccacagcatagaagtcggccactacaccctcggcgtggcggcggaagtgttccgcctgttccatgctggcgtatgaaaccttgttggcaaggcctcgccgcccgctggcgtcctcgtaaatcccggagtaggcaatagacaccttcatctctttgctggggccgtgttccagccggtctttcccttgcagagcaaggtacacgccgtccatctcctcatacagtaccggcgtttcataggtcccagacccacactcggcctttgccgccgccaggctgtccactcgggcttgctcccagctcccagcgttctggacaatgcgccagacgctctcgtggctcaggctcagcccggtcagatcgttgagtgtggcggctgccgtccggtgactcaccgcacaggccgcttccaccgccatcatacacacagtatcgctgaaaaggcctaccgtgtcaaggcccatgctcctgtccagcaggtataccgttgccctgggctgctccgcggccccggacagcaggtagacatggcgctggtaccccacctcgcccatcactgttttgagcgtggtgggccggtagcccttgtcccggtacatcccacggtcccgctgccgagcgagcgtccgatccgcctcctctatgcactggcgcatgatattgcggccgagggagagaacggcttcgtacaccgctttctccagtgtggcgatgtctacaaacttctcgccccactgaaaaatctgcttgccttgtgtctctaactttgttaccattaccttgggactcctttgcagtaggtgtttgttctcaactcacaattctactgactttggagccccaagggaagcgatgttttcaccgtttccctttttcttttgcctacgataattttacactaacaaaagaaacgtgcgccatccggctcaagccggacggcgcattttttatacagtcttccgtggatcctgtgccggacacttcaataaaaacgaatctaacgttactaaagagtcttctttaacactataatatcgtcccgcagatagtccagaaacactgccatggcggctgagaccgccacattcttttgcagcagatatccgacatggagtgagtcggagatctcctctaccggcatggcaacaatctcacccatcccgctgtggaaggcatcggcgttgctgttggtcaggtccggacctatgctgaacgcatcggtaaaccgaaccagcgccaccttgctgcaccggtcggagacgtgaacggtcttttccgcaatctgatggaacacaacttcttcggtgtattcagagcgatccgcctcctggtcataggttacgaaggggtattggagcagttcggccatgctgaccttgtcccgcttcgcaagagggtgacttctacgcaggaaggcatacgttggcaagcgttctaactcggtgaaagtcacatggtttatctcaaaggtcttttccagtgctggaatgtactggtcgtgcagggccaccacccccacatcactttttccagcagccacgtcactaataatggtataggttgggcactcccggatggcgatatcatagctgttccaggagagctgctccataaatctctggaatgcccggacggcaaagggaagccgctgggtcgaaaccgcgaaccgtgtaggcgcatatctccggtggcgataacgccgttccagggcgcggctctgctccacaatttcgcgggcatagcgcaggaagtcctccccgtcgggggtgggctggataccgcggttactccgcaggaagagttgagttccaagctcggcctccagctccttgattgcggaggacagggtggactgagagatgtaaagggccttggcggccgcagaaaacgaaccgtgctccgccactgcaaccacatattttagattttgaagcgtcacagaggtcacctcccaatgggcgtttaatccctcatataggaaaagttctcaatcagttcccgggtataggggtgggtaggggcattcagtacggcctctgtctccccttgttccagcagctttccccggtacatgatgccaatccggctgctcgcgtggcgcagcagatcgaggtcgtgggagatgagaagatacgatactccggttcggagctgaacctggtgtagcagatccatgatctgggcctgtaccgacacatccagcatagaagtgggctcatccagtacaataaactcaggctggagcagcatgatgcgtgccagcacaatgcgctggatctggccgccgctgacttgggaggcccggcgctccagcagctccggctgaatgccatagggctcaatatgggcgcgaattatttcatccatatcctgcttgccgggcagatcgtggagcagaaagggctcccgcagactgtccagcactgtcatccgcggatttagcgaagtgtccgggtgctgaaaaagcatctgaatgcgccggcggtaggggagcatctttcgctgaggaatgtacaagaggtccgtcccgtcatagagaactgtcccggaggaggccgggagaagccgggtaatcatccgacccaaagtggatttgccacaaccggactcccccatcagcccataagtttgtccgggcccgatggcgagggaaacatcgtccaccgccttgtgggtgcgtccgcgaaggcggttggagtgaaaactttttgagaggtgctggacttcaagcgtagcgatggcaacacacgctcccttctccacaggggatggatttcggctctgtatgccggcaacgagcctccgcgtaagggcaccggggatggaatacgcagccggagggctggtcggtaaaggcgggagaaaagcccgccataggcttcatgcccaggtggggcagcgaggcgataagcccctgggtataggggtgcctagggtgctcaaacagttcccgcgccgcgttggtctccaggacacggccgcagtacatgacaacgatacgctcgcagaatttgcgggccagcagaaggtcgtgggtaatgacgataaagccgacgcggtactggtcccgtaccatacagaaggtgtcgtaaacctgattgcgcaccactgcatccagtcccttggtgggctcatctgcgatcagccattgcggacgtgcagccacagcgatggctgtcagtacacgctggcgcatgccaccggagagctcgaaggggtaggcacctgcaatctgcttcgggtcggaaaaggccatctgcctgagaagctccagcgtgagtctccggcagtctggggtactttttccagccagacggaagacctcctcgatctggcgtcccacccgcacgctgggattcaatgaggtggccgggttctgagccaccagagcaatctctctgccgcggactgtgcacagctcccgctcggacagggcagtgagctcccgctctcccaaaaagatctgtccggtgacagaggcgttggactgaagcagtccgagaatagacaggcccagcacagacttgccgctgcccgtctctccaatgatgccggtgacctgtcgctccgaaaatgcgagggagacatggttgacggcgggaatatcacccgaacgggtagcaaagcggacgcagaggtcctttgtatacagttccatgtgcgtcctccctttacagcatgcgggccgcgccgtcatcgtggtcaaggcagtcccggagataatcagcaatcaagttgatgctcaggcagaacagagtcaggcaggccgcaggggccagtagaacaagaaaatccttcacatagtagagcttggcgtcgttaatcatgatcccccagtccgctgcgggtgcccgcaggcccaggcccaggtagctcatggcggccacggtgagcaccgtagagccgatccgtgtggcgattagaaccagcagagggagcaagatattgggcaggatatggcgccgcatgatatagaagctcccgccgcccatggcccgtgcgccctcgatatagtgcagctcgcggatctccagaacttgattgcgcacaatacgggagaatccagcccaggagctgaccacaatggcgatcagcagactgcgcataccggggcccagcagtcccaggatggcgaccacaaaagcggcgctggggattccttggaagatattgaccacagcctgaatcagttgatctatccatccccccagataaccggacaccaggccgatagtcatgcccagcaacagagtgcatccggtggcgaagaaagcgatgaacacagaagagcggctgccgtagataagccggctcagcagatcacggccgatatggtcggtacccagccagtgttcagtggagggggcggcaaggccgttggccatatccaccgcgttggggtcgcagggtgccagaaaatcagcaaagacccctaccagcaggaaaagaacaagcacagttagtgaaaggatgaacaagacttttttaccacgcatgctcagccccccaatcgaatctgcgggttcagccaggcgcagatcaggtcggccagcaggcagaccagaacaaagacaacaccggtaaaaagcacatagccctgtatggcgatatagtcccgattattgatggcggtgagggcgtagcttccgattcctgggacggaaaatacgctctccgtgatcatggagcctcccagaagaccgccgaaggtattggcgatataagtaatggagggaactagagaatttcgcagtgcatgacgggaaatgagctggcccctccgcaggcccttggcctgggcggtcagaatgtaattcttgctaagctcccccagaatggaagagcgaagcagccggataaccacacaggccgagccgatggaaatagcaagacagggcatgaggaagcaggacagtgtctccgcgccgctggtgggcaagatacgcagcttttgggcgaacagccagatcataaaataggctaggcagaaaccaggaatagacatcagaaacaccagtaaaactcgcccgagcaggtcaatgaatttgtcccggaacagtgtaagcagcaggccgccagcaagccccaccacagtaatgaccagcaacgccattccgctcagcaggagggtgttgggcagcagccggagaatctcacccagcaccggcttgtcgtcaatataggattcccctagatcaccgtgggctgcgttccagatccagcgcccgtattgcaccaaaatgggatcatctaaccccatttccgcccggagctcctggatttcctcctcagtggggatatagttgggatcggcgctggcccgattggtagcggggtctccccgtgcaaccagccccagaccgaaggccagaaaggtgatgccgaccagaatgggaattgtccacaatattttttttgcggtatagcgcagggtttgattcaatgaaattcctcccttgaaaaacaccgcgccaaagcacagctttggcgcggtgtggcggttactgcgcgttcacccaggaaagatgactcagatccaaatggtcactgaaatcctcgtagcctgtaatctgctcctgattgtagatgaggttgctggtgtcgtagaacagaggaataacaggcaactcagtgttggcaatctcctggagctccacggccaactcatggaaacggtcgtcgtccagggtggtcttcatctcggccagcagctcgtccacgtgggggttgctgtaggccaaatgctgggatttattgtaagacccttcgctgctcatatagatatccaggaagtggtaggcattgaggttggacataccatgagtcatgaagtttgcccccagttcaccggccttggacatctcagagtaagtagaggagtcaatcacattcacggtggcatcgataccgatctgggaaagctgggactggatatactccatcatctccttataagggccgcggtccagatacagagagcgggtatacatatccaacggaaggcgctcgtcccccagcacctcacgggccagctccttggccttgtccatatcatactctacgggcagttctacccagtcggggcacatacggttaatcaggttctgcgttggcatggcatagccgccccagagctggtccacaataagctgacggtcaatggccagacttaccgcctgacgcaaacgcatgtcggaaaatttggtgccctcacccttaagaagcattatatgggtaatattggaggtctgcaccgccatggcaaagcggtcatccttgagaagctcgtcccccagggcggcaggcatagccccgaggtccagcacccccatgacctcctcgctgtccaaggcggcatagcgggcctgagggtcagtgatgatgcgcacgcggatattctttgttttggcgggctctccccagtagccgtcaaaagcagtgatatcaacgtactcatcctctttgatatccttgataatataggggccagtgccgacaggctgctcagtgaagtacccggtttccgtgtcccaggagccggggtagaaaatacagcttgcagtgtccttcatgttaaataacagccgggggatggggtcggtaaagctgacattgacggtgtagtcgtcgaccttctcacagccaatgaggccggggtagagctcgtccaccttgaatgtagtatactgggaatagccgctctccatgagcttgtaacggttgaagttctccaccacgatatcagcgttgaagtcctctccattctggaacttaacgccctgccgaaggtggaacgtccaaacagtggcgtcttcgttgcgctcccagctctcagccagcacccccatggggtttccgctctcatccacggagatcagcggttcccatgcacccaggagcttgtgggagaaatagacatcctccagaccaggggccagagtacgggcaccagccaaaacgatcatatcgtctgcggtgtgaccggcggatgcgggttccgcgctgggggagggggcagttgaggggctctcttgggtggcggggctgccgcaggccaccagagacagggcaagtgccgcgctcagcagcgcagcagtcaggcgttttttcagattcatagaatcctccttctttcggtccaacttatatctggaaacgcgcaagtcctgcggatgcagaaaatgtgccggttccacggccgtcttccagagtcagaccccataagaggaaaaaaagcagaccattaaaggtccgcttcgcacaaacagcgtttccgggtttccagcggaaatcacctgtcccatttgtgtcgagaggccttgaccggaagcatcaacatacttcatcaagcaggtttcctggctcacagatcgccgcactgacacgccttctcgtgtaatttacacaatggcatatgtgaaagtgctccctgttcacagtgaccggatcgctcgggacttccacccgattcccttttctccgctgaaacgcacaaacaaagcggacacttgacgaaaaacaatattttattgtggatattatcatagcaatctttcccacggaagtcaagcagatcccccagggaagccgcaggcacgggcagatctgctatcggaaaaaccaatattcaataagggaaaatggaaatagtggaagatgtctccgctgtgatataattaaaaattacagacaacatgcaagggaggcgcagaaagtcaagatgttgcgtattgcgttttacggaaaaggtgggatcgggaagtccaccgtggccgcccatctctccgcggcctttgcccgaacggggaaacgggtgcttcacatcggctgtgaccccaaggcggactctacccgctgcctgacgtcgggacgaatcccaactgtgctggagactctggggaggtcggaggagcttctagcccgggagcagcttgtctttcccggggcgttcggcgtctcctgtgtggaggcaggaggtccccaggccggcgcggggtgcgccggcctgggcatcaccgccatggcggacgagctcaaccggctcggcattctggaggagccctgggacgtggtggtgtacgatgtcctgggcgatgtggtatgcggagggttcgcagtgcccatgcgaaaacattttgtagaccgggtatacctgatcacctctgccgatttcatggcgctctacgccgccaacaacatcatgcgcggagtcgcccgctattccggcgccgctcccctgttgggcgggctgatccaaaaccgcagccacggagcgggagaggatgccttggtacgctccttcgcagagcaatccgggaccagagtcgtcggtatcctgccggaagaccgccagctccgaagagcggattatctgcataccaccgtacaccatctggaaccggacggggcggcggccatgcgctttctggaactggcccagcggctctgggatacccagcccaccagcccccggccactgggggacgaggcactggaggcattctgccgccgggcagcagaacaggaggtggaggggcttgcgtgacgcctgccgtgtggaagtctattcggcggaggggggcgggaagcactttatgacccttccggaacgcatttggcaaaggggagaccttcttctggcggctgccggttctctggcctgtgtgcgggcgctttacctgcgcgcggcagagctggggaaactccaccaattcctgccctgcccgctgacgagggcggactacgccgccggccaggcagcggagcatctggcagccaggcttcgggaggccgcacgccgccccggcgtaggcggggtcgtgctctacgcctcctgtgccgaggtgctgacgcaatgcgatctggaacaggttgcggagcaggctggccttcccgtccggattctgctgcgggggcctctggtggcccgcacccggaatgccgtggcagagttggagcaaattctgtccacctttcccccgcctgtgggggaaattccccggggcagcgcgccgctgcccgttctgccgccggatttcagcggagtggcgtcccttctccagagctgggacgcctacccctttctgttgactgccggaggatgcaccggatgtctgacactgggggacgacgccaccgccggactgcgtctggaacattcacggtttgatgatctggagctggccgcgggctgcgaggcagcggcagtcaacggaattgcgagaggctttgcgcacagcggccgcgctttctgcggccttatggggagtgcaattcccgaactgctcggcatggactataccgggatacaggagagtctggccgagcggggggtcccggtactcaggttcccctgcaccggatttgagtccgcaccagtgggcgtggaccgggccctgcggaatctggccacttggaggcgcccggaggggcgtgacaaccagaggatctctattctgggctattccgatctcgcgctgggctccagacagccgctgcgcctcggggcggaggctttgaccacccgggggtatcaggtctgtgtctggggggaggaaggttttgggggcggagagctccggtctgcgccggccctgaactgggtggtgacggccgaaggattgggggcggcacggcaaatggaggccgactatggaatcccctatttctgcggcctgccgctggaacgctatggactggagcgatggctgtcccgtttctccacggcggcaaagggggccccgccagagaagccggtggaacatgaaacagggaaccgcacccttctcctgatcggagcgcccattgcaacggaaggactggcctgggcgatccggggggaatatccgaattgccggatcctccgcgccttctatgccccctaccggactttaaaggagctttaccggccctttctcaccgcagatacgcttctgtttggcgatccggcggagctggccgcttgggcgacgcccgatgtcctgctggcagatcccctctttttcccctccctgcggccgtggtttccacgggcggagcttctggcctgtccagagcccggagtgtgcggcaggggtggactgcccgcacggtggctggaggatgtggcgtgtgtgatgtcggctattggaaaaagtcatacctggtaatggaaaaatgcacttctcccggtggttgccggatggcggccgacgtgctatactgtaatcacaaagttcaatatagaaaaggcattggagcatttcatggaaaccggtgaaagtccggtacggtgccgccactgtgagatggagcatcccccacaatgacactgagccgacaggcttgggaagtcggggtgatgcggagaagtcgagtcaggatacttaaatgctccgggacacctggtatctaacgagccattagatgagggtgccgcgggttgctctgcgctttttgcggtacgcttcttttggaacaccttctcttgttcagatacaggagaaggtgtttatttttgccggggagcaggaccgggacgtccgccctggcctcaggccccctggacagagaatttaaattggaacaggaaaggaatggtacttatgaaacgacatttacaccgcctcggggcggccgccgtgtccggcgcgcttctggcctccctgctgactgcctgtggaggggggatcaccgcggagaccccgtctgttgtaccggaatcccccgcacagcagacggagcaggctgtggcggaaacccgcaccgtgacggatgcggcgggcaacgtggtggaggttccggcggagctcagccgcatcgcggttaccccgctgccctggtcctccgtgatctatgccatcgacggcacctctgagcacatggtctccatcaaccccggcgccatgaccgcctataccaactgttttttctccaagctggacagcggttatgcggagctggacaccaccagcatcggctccgacttctccatcaacatggaggaaatggtcagccgaggcgtccaggctgtggtgatctgggactatcagaccgaggaagcggaacagctcaaggcgctgggcatcacgccggttatggtgaagaacgagaccatcgaggatctccaggccagctttaccgccattggtcagatgttgggcaaggaggagcgggccgagcagttcaacacactttataccgaggcgtatgaatatctgcagtccttccaggagcaggtgaatgccgcggacaagcccaaggtgctctatctgcgcaatgccgagctgaagctgcagggcaacgacatgtttatcgcggaggccctggagctggcaggtgcagacaatgtggccgccgatctgtccagcatcaccatggaggagatcctggccattgaccctgatatcattctgatgagcaatttcgactcctttacaccggcggatctgtacgagaacaggctggatggacaggactggagccaggtatccgccgtactcaatcaccgcgtctataagacccccatgggtatctaccgctgggacgccccgggcgtggagactccgttgatgatgcgctggctggcccaactgattcagccggaaatttttgccgagatcgatatcgagcaggacaccagggcctttttccaggactatttcggctacagcctgacggatgaagacctggcccagatctttgccgccgatgccaatgcggacagccagtaacccagccccggccctggagcaaacaccccgccggccctgctcctttccggttctgtttctgggatgtctggccgcgctgctcatcctgaccatcctggccatcggagtagggcgctatgccatctccccggcgaccgtggtgcgggtgctcctctccagattcctgcccatcccggccacctgggagggacaggcggagagcgtcatttttaccctgcgtctgccccgcatactggctgccctgctggtggggagcgccctctccctctctggagcggcctaccagggggtctttaaaaaccccctggtggcgcccgacatgctgggcgtttcggctggcgcctgtgtgggtgcctcggttggaatcctgatgaacgccggcggagtgggaattcaggccggagcgctcctgggcggcctggctgccgtgctgctggccatcgccatcccaaaggtcatcaagaatcaatccatgatgaccctggtgctggcaggcgtgattatcagcgggctgatgaacgctattctgggcctgctgaaatatctggccgacccggagacgcagctcgcctccatcacgcactggcagcttggcagcctggcgactgcagtgtggcgggatgtgttcaccatgggaccaccgattttggctgcaatcataattctcctgctgatgcggtggcggatcaacatcctctctctgggcgagaatgaggccaagtcgcttggcatggatattcggcgtgcccgtgggatcatcattttctgtgccacgatgctcaccgcctgtgccgtctgcaccagcggaacgatcggctggatcgggctggtaatcccccattttgggcggatgatggtggggccggacaaccgcaagctgatccccctatccgcggtactgggggctgcgttccttctgctgattgataccctggctcgggtgctcaccagcgcggagctcccattgagcatcctgaccggacttatcggggcccctttttatttctatctcctgttgaaacaaaggatgaagctgtcatgattctggaagtagaacatctgtccttcgcctaccggccggaacgccccctgttttatgacgtgagcttcgcctttgagcagggacaggttctctctattctgggggcaaacggagcgggcaagtctaccctcctcaactgtattgcaaatctgctgctccctcagcagggggaaatccgtctccacgggacgcctctctctcggctggaactgcgggagatttccagaatcatcggctatgttccccagagccacacccccgcttatgattatacagtacgggattttgtagtcatgggccgggcccctcacctgggaaccttccagcagcctggacgtgcggactatgacctggtggacgccacgctggaggagatgggcctgctcccgctggccaaccggccctatacggagctcagcggcggggaacgccagcaggtaaccatcgcccgggtaatcgttcagcagccggagctgatcctgctggacgagcccaccaaccatctggattacggcaatcagctccgggcactctccatggtgcgcgccctggtgaagcggggcttcggcgtcattatgaccagccacaatcccgaccatgtgcttctgctgggcgggcaggttggtattctggggaatgacggccgttttctggtcggcaatgcagaggaggttatgacggaggagcggcttcgtgcgctctaccgcagcgacctctacttaacctatgtggagcgggtggggagaaaagtctgtatccccggccgcttgaaatcggatgaataggagggtaagatggagtcgatcgaggttttggaggaggggaagcttctctccttccgattcgatgagatgctgaactatcacggccccggtttcccgggtggcgtggcccacggatttaaggtcatgcagagggcgtttccgctgctggacgacgggaacctgctggagcgcagggagatctcgttcgtgacggcttttccagggccgggggcgcgggatgcctttgagctagtcacccgctgccttacggacggcaggtatgtggtggacaaggagctccccgaggcggcgaacgagctggagagtcccggcgggcgctattacttccggttgagctaccgcgggcgttccgtcgcagtcacgctccgccccggctacgtgcgggaggaattcattcaactggcccgcaagaaggggcgcacggaggcggaggagcgtgtgcttgccggaatgaaacgcgacatggccgcccgcctgatggcggccaaagcggaggatatttatcgagctgagcggctttaagtgaagtcgaacgtaaaaacatgcgccatggagattcccgaaagggcctatggcgcatgtttttacttcgtaatttaatgggacacaccgtaaaaggatgctacaggcagatatgtaaacggagcgcagagcaggattggaatgtcaccttagtgaaggtaagagccctatctgttgtcatctcgcttctcttgatgccgttcggcctgcatcagcagacaaagacaatcgtttttcgtttaagctcagggacatctaccaagacggattccaccccaaaaaccgtccggatcagatccggttccaaaatggtttccggtgttccctcggccacaactgcgccacggctcataacatagaggtaatcacaatagtcgatagctaagttgagatcgtgcatagccgcaaagacctcgatacccaggctctttacaacccggaggatctggagctgatattgaatatccagatggttagtaggctcatccaggatcaaagcctccggctgctgggtgagggcccgcgccatcaaaacccgctggcgttcgccgccggagagcgtgttgaatttgcggttggccattccctccattccaaccagctccagcgccttccaggctaatgcatagtcctcgtcgttgtctgtctccatcagcttcttgtggggggtacgtcccatgaggacaacctcctctacccgaaagtcaaagttcagcgtactcatttgtgtcataactcccaggcggcgggcggattccttcaaggagacttcttccaaagccttcccatccagcagcacagtcccggaatggggcttgagcactcggtaaatcgtcttgagcgtagtggatttcccgctaccgtttggtcccacaataccaacaaaccgcttggactttacctctgcactgacatcatgaataatggtctttcccccgatcgccaccgatagatttcgtacttccagatccatttactcatctccaaatccataggatttcgtcagcatcagccaaacaaagaaagggccgccaatcatggccgtgacaataccgatgggaagctcctcgttccccaacaccatacgggctgccacatcacaccagatcaaaaaaatagatccgactatcgttgataacaccaataccctgcggtgatcggaacctacaagcatacgcacaacatgggggataatcagcccaacaaagccgattgttcctgatacagctactgcaacaccggtgattgcggaggaaaataccagatagacctttcggatggttgccacctgaatgccgagggtcagggcggactcgtctccgattagaagcgtgttgagtacacggaattgggtgaggaaaaaagcgacgccaagcagcacgacaacaaaaggaatgccaagcaaattccaggaggccgaggtcattccccccattgtccagaacgtgacagagcggataccttcggcatcgctcgccgtatagataacaaaattggtaaaggcggagcagatcgcactgacagccataccggctaacaacagtttaatggtgttccccttggattttccggaaaacgccacggtaaagacaaatagcgcggtgaccagggagcccaggaacgcacccacggacacaccataattcccaaaccaggagaaagcccccaggaggatcgccagtgtggcacccagtgaagcgccggaggaaagccccaatacataaggatccgccagtggattgcggactaccgcctgcatcaccacaccagagacagacagacctgcccccaccaccattgccatcaagacgcgtggaaaccggatattccaaatgatatctgcggttgtactctggaggagttcggcatactgggcgggctcactccggaaaatacggcagaccagaatgcgcgccacatcaggaatggcgatatccacagggccgaacgtaatggaactcaggacggataatagcaacaggaccagcagtaccacgacccatagggtcaatggaaagcgtcggcggccggcatttaggctggtatttgcaatagatggctttaccttggtcatattcattcccctttttccgcggttcggcgtttgcttggaacggttcgggcggcccaccctctgcgtgtgggccgcccgaaccagcctctgcatctacagccctatgggatggcaaatgcaattctgagagttattctgtaaaaagttcgggataaaacccctcggccaatgtttcaattgcctctatagtgcggggccctccgcaatagaaagctgcatgatccagcaccacaaagcgatcattctgaacagcctgaaggctctggaggaccggattggccttgatcgcatcgattttttcctgggcaggtgaggaggagagatccagtatgaccaggacatcggggtccaaactcaacaggacctccatgctctgctgtccattatcgttggcctgaataccaccggccaactcggtcagattggtattgaagtccgtacccccccggcccaggaactcattctcatagacatactgtacggtgacaacttgaacacgctcggactccgggatagtggataccttctcctggatgtcagcaattcggtccttcatatcctgaatcatggcttgggccttatcttcgatatcaaaaatctggccaagcttctcgatatcatcgtaaaggaaatctacggtgcgattgccaagcccactgacggtgttgttcatcaggtaggtatgcactcctcgttcatgccagtcgctaactgcaccaagcgcatcctctgcaaagagagacccccagcctacaatcaaatctggcttctgatccagcacaacctcttttgagggatagccggactccgcaataaagggaatggagttgtactcatcagccatccgttcataaacagggctgaagcggtgggcagtcgccacaattttatccgtcaggcccaatgcaatcagcagttcggtgttggcctgagagatgctgacaacccgctcagggcaggcttcaaaagtctgttccacgatttcgccgttctgatcataggtctccaccgtgaccggatagtggttgtctgcctctacgccgttggattcaaccggagtttgggaagttgcaggagaagtttcttctcctacaggctgcccgccgcaggaaaccaggccgagcatcatgctcagcgccagcaacagcgctgtcagtctcgttttcatgttactactcctttcggtcattcagagaagagttccgggtaaaaaccacatgccagggattcgatcgcatcgatggtttcatagttaccgccatagaagtcgacgtaatccagcgaaacaaaacggtcatttttgacggcgttaacttcgctgagggatggattactcttgagcgcatcgattttttcctgtgtgggagagtcggtccggttaataatcacaaggacatccgggttcagtgcaatcaggttttcgatgctctgctttccaaaagcctcgtccaggcagatgccacctgccttctcaatgaggtcatacgtaaaatccgtatccttacgcccaaagaattcattttcatagaccatctgaacggtaagaacggttaccttgtccgtatcctccaatgtggacactttgtcggcaatagcctgctcccgcgtcttcatatcggagatcattgcctgggccttatcttcaattccgaaaatttcccccagcttctcaatgtcgttgtagaggcgtgacaccgtgcgccgcccctctacgccggaggcgctgttatctacgatgtaagtggcgattccccgctcgttccagtcctgcacactgccgagggtatcctcagtaaacgtgctcccccagccaatgattagatccggctttgcatccagaaccacttccttggagggactatcattgtctgcaatgaatggcagggcctcgaactcgtcccggtacttctcattgacatctccaacacttctacaggcccccacaatccggtctcccagtcccagtgctaacagaagctggattgcctgaggctgattgcacacgacccgttccggtgctttttcaaaggtttcggcgtagagcgtgccgttttcgtcgtaaacctgcacagtaacaggataatttccctctactggctgcccggtctccacaggcgcggaggtctccggtgggagtgtggtctgggccgatggcgccccgcaggacgccaagctgatggtcattacgaaagtcatcagcagagacacccatttcccttgtttcatatgtgttccttcctttcctgttcagatgcgatactctatgtccaccgcaagctgcggctgacaacatttcagtcgtacttccaaggatacctgggcgcaggcataaaaatactctgccccctggacatgggagcagagtatttgtcagcgataacagtctacagcaacctgcgtccatcccatctctcagaggtacggaaacggcaaacagaccatgcgcaatatcccgactcgacccatccgccgtttccatatggcggtacctaattcagcgccttcccaaggcagtgggatgccccagtggcaaaatgctgtttcgttggtcacacggttgctgagtacagttccagattctcactggagagccatttgatacagctcttcgcactaaaagtgcgatgtttctgcgcacgacctttgtcctaattctattttatgagtacttctccgcgccttccatagcccggattgtggtgctattatagcacctctggacgaattttgtaaagcgagacttttttgccggctaggctgaacgggccttttctttccggccgggctgtgctataattccttcatatacgttttcagcaagtggccagactccgtctggttagagggaatcgggtgcaactcccgagcgatccggtcactgtaagcggggagcgtgctgcagatcgccattgcatgtttcacatgtgagaaggcgcagcacgtgacgagccgcaagccaggaaacctgcttgctgaatttgtggggacgcttccggtgaaagctgctccacaggccgccggccctgccggtgcgcctgtctgcaagccggctccgcgtcagaatacgcggggccggcgattttgctttttccgggcagagaggagaaatgcgcatgcgacagcctttttttgaagatctgatgaccgcaatgtacccctccggcctgctgcacacctttggtgtaaacgggaagatctccggcagcgtgggggcggtgggggaaaagcaggaggtgcttccgctcctccacagcccgcggggctgtgggtttcactaccgctattccgcccggcgtcggcaccagcccttttacagcgtgctgacctccaatctggaggagcgggacatcatctgcggcggggaggagaagctccgccaggccatacgggacgcctggagccgctaccgccccgggctcatcatggtgatcccctccccgatcagcgacattctgaacgaagatgtgcgctccgtatgcgccgagctgcggcgggagggtatttcggtagtgggcgtccagtcggagctcttctcccaccgggacaaaaactacacccggaaccgtctgaaagagctggcccaccagaccatcaccggcgacaaccggctggagatggagctaaagggctgcggcttcaccgaggcgctctacgccctggtggagcaggtgatggagccgtccgctcagatcccgcacagcatcaacatcgagacggtgggctgggggagcgagggaaaggccgccctgcgggagctggaggtctttttgaacggctgcgggattcaggtgaacacgtggatccccagcgcccccctctcctctctggtacacgccccggccgcggaactgaatctggtcaagcgggttcgctgggccagacgcatgcgggagaaattcggaaccgcataccttcacatcggcggcgcgggacgctacgccggactggatggaatctgcaccttttaccgggacattggacaggccctccgcatggaggcggcggtggagcccgtcgtcctggcggcgcgggcccaggccctggaggagacggcggaggcccgccgccgcctggggcaggcccgggcggttctcgtcagccgcagcatccagcaggctcccttcgagctcaaatcctatgtgcgggactatggcctgtcggtctcccatctctgtgtcatcctgaccccggagagccgtaaaaacctgaatgtcacccccgcgctggaggacagcctgctggcccgggtacgggaggccgccgccctctacagcccggagacacagctcctcctgaacccggcagaggagacgctgcgcggaatcttcgcagaggcggatgtggtggtgggcaccggcgacttcaccttggaggggatgggcgcgccgctgatccccgcggtcaacgaaaccacctccctctcctttccctcctatgtccgcacggtgcgtaggatgtgccgccgcctggagcacgggacggagcgcagcagtcttctgctggggaaaatgcccttccaaagccgccattacccactgtactgtaatcagtctaatctggccgccaaggaaatgtggtccagaatgtggctcaatcgaaagggggattccgtatgaggccggccagcggctgcaagctctttggagcttatcaggctttgggtggaattcaggacggcgttgttctgctccactccgtggtgggctgcaattttggctccatgtctctccacgttgcccaggatatgcgggatatccggcagacctgcaccgtcatcagcgacagcgacgtggtgttcagcggcgaggcctccctggagcgggccgtccgctccgcgctggagctcttccaaccgtccgtcctgttcgtggtcagcggctgtgtgagtgagatgattggggacgatatccccgccgtcttagcccgcatcccccatgaggcgccgctgctccatgtggaggcggcaggcttccgtggggatgcggctcgcgggctggaggctggatggctggcactgctcccgctgatgaagcccccggtcccccggccttatccccggccctatccccgttctgatccccgtcccctggttaatctgatcgggctcgggatggatgacccccacgccgccgacgatgttgaggccctccgggctatgctcgccccccaggccgcactgggcgccgtgctctcccgctgtacgctggaggaagtgcgccgcgccccctatgccgatgtgaacctggtgctccgtggaaaggggcgtgagctggcgcaagccatgaaggagtacttcggcataccgtgggaggaacttgattacccctatggcgccgccggcgcggacgatctctggagtcggctggagcgccgcttcggtctggattatcatcaggcccgggcggagctggaccgtcagattgcagagggagccggaaaagcctaccgctatttacaggccctctacggcatgccagctgcgatcctcgcctcggggccgcgggccgacggtctgcggcgctttctggagcaggagctggggatggaggtggtgtgctttgcccgccgggaggagctctccgaccaggaggacttctaccgggagctgcgcggctccgaggcggcgcttctgttcggctcctcctttgagcaggacggtgccgacgagctggaaattccgctgatccgcatggattacccggtgtttgatgaggtctgtctgaccccccgcccccacctgggcgggcagggaaccctccatcttctggaggacatcttccgcggcatcatgaacggccgcaccttaaagggggcgctctatcagtgaaacgcatctgcgtctatggaaaagggggcatcgggaagtccaccgccgtgtccaacctggcggcggccatggcccaggccgggaaacgggtggcggtagtgggctgcgaccccaaggcggactccacccggggcctgatggggcggcgcatccccaccgttctcgaccagctcaagaccggcgcctccggggagatcgccttcacggacagccggggcgtccgctgcatcgaggcgggcgggccggagccgggcaccggctgcgccgggcggggcattatcgtggccatggaggagatccgcagccgcggcctgctggatgaccgggatgtggtgctctacgacgtgctgggggacgtggtctgcggcgggttcagcatgccgctgcgggagcaggtggccgacgaggtgtatctcgtcaccaccagcgacttcatggccctctacgccgcaaacaacatctgccggggcatccgcaaatacgcccagagcggcggaatacgcctggccgggatcatccacaacgggcgcagcagcgtggacaacgacggcctgctccaagcctttgcgacggagctgggcaccacggtggcgggaaaaattcccatgagtcccctcatcggccaggccgagctggagcgccaaaccgtggtggacagcgcgccggacagcgcgcccgcccaggcgttccgcgccctggcgtccgtcctcctggacaaccgcggcggctgcatcccggagccgatgagcgacgacgggctggaagcgctctgccggaaggcggccccgctttgattccggccgagcacccctgcttctccgcccaggcccacttccgctatggccggattcatctgcccgtggcccccaggtgcaacatccggtgcggctactgcgaccgccgctatggctgcgccaacgagtcccggcccggcgtcacttcggaggtcatctcccccgaagctgccctggaccgcgtggagcgcgccctgcgcctggacagccgtctgcgggtggcgggggtggcggggcccggcgagcccctggccaaccccgccaccctggagaccctccgactggttcgttcccgctttcccggactcctgctctgcctgagcaccaacgggctggttctgtctgatgctttgcccgaactgctggactgcggggtttccaccctgacggtcactgtcaatacccgctccgtcgtctgtgccgggcacgtctaccggacggtgggcggcagcgcggatgccggagccatggcagcctttctctccgctcaacaggagggcgtggccaaggccgcagaagccggacttacggtgaaaatcaacaccgtcgtcatccccggcttcaacaccggggagattgaggaaatcgcctgttgggccgcccgtgcgggagccgccgtcatgaacctcatgccgctcattccccaggccgattttcggggctgtgagccccccagccgggcgctcctggaggcgctgcgcgccagggcccgtgtccacatcccccagttcacccactgcagacagtgcagggcggacgcagtgggtgtacccggagaatagactgctgcttttgattgataaagccttgaaagcggccatcttgtaagcacctgcacagatgtacaggttttgaatagcagaaactcgtgatcgctatcaaatcggattaagtccgagacagctcatcagtcagttcagcttgtcctacctttattcggtaacagttcgaggtaatccccccgctctcccgaaatcttgcctgtttctccacccggccctggcggattagctccgccagggcccgctttatggtcgaacgggagaggctcagatcttttgccatggtgcctatggcgtaccagctctcgccgtctttgtttgctcggtcatgtaggtagaccagcacctgcttggccctggcgttcagctccgggtcattgtaaatctcattgaagtagctcatttctgtttctgttcctttcccatatgataattgactgtccctgtccggaggggaaacgcccgatagatggcgctggtcagctccgccttgctggcgtagtagaccttccgggctgcccgctggggcacctggtagggctccccaaaagtgatcccccactccaggaacagccgcaggcgggtctgcatgggatgggtcccggttttcatgacgatgaagtgtcccttggggatggacttgagctcatccggggtcatgagaggccgttcaatcatctggaggctctggctggtatcgttcttcccccgggagatggaaccactcatcacggtgcggctgcccagggccttggacagcacctcagcggtctggctattaggggcgaagccgccgaagatggtgtcctggcagttatccgtcaggatctccgccccctccttgccgtagttcttctccaactgagccagggactggatgatgggcaccagggtcagccgcctggagcggccggctgaaaacaggggcaggatgtcgaaggcgggcatggtgcccagctcgtcacagaaaaataccacccggttgggcagcttcccgtcgtgctcatccgccacggagaacaactcccggctcagggtctggatcatcagcccagccatgaaatttttcgtggcatcttcctctggtaaaatcagaaatatcgcagatctcttcgaggcaaagctctcggcgtctatggcgctatcgaagcagagcacctgctccagctccgagtccaggaaggtatttagccgggagagcacggtggacatgacggaggccatggactgctcggcggcggtgagggcggagccggagaaccacttggccttgtgctcctccggcaggcggtccatgaggagctggaactcgttcttgcccggcaggatgctgggggctatcagttcctgcaccagcttgaacacggacacgatgtgccgccgctcccgcagctcaccatggatccttttgggcggcaaatattccgccagtaagagggtcacagcggtaagcacgccctcagctgcatcataaaaatattgattttgtgcgaaattctccccgtctgggttgatgatagtctttgagagaatcttagcatatttttccgccttggcccgggcagccaggttggtgggatctttccagcagacatccatgtagtggttgatcagggtgagcagattgtagccgtcggagcgggtagggttccgaagatccaccaccgatacctggtagccgtagcagtcccgggctatggcgccgtagttccgggccagatctcccttggtgtcacttgagaaaaaactcataccgctggcacaggcgtactcgatattggggtacaggaaatatgcggtcttgcccacgccggaggcgccgatcatgaggcaatggacatcatcacagtccactagggcccggatcccaccgtgcttccacagcttctctgggatgagcggatggactgtcttcccaagcaaacggaactccagcggagccgggagctttcccacacagcccagcaccaacccctgtgcgtccgggagctgctcccccttccgccacagcgcgggctggaagggtacggagtggaaggtcttcctcacctccgccggtgtggcccagcgggcggttccgtgctggccgtcgcccacgtccttgctcttgatgctgtccaggctgccccggctggagaaggcggcgatggccgccagggctccgaatactgctgccaacaggagaatcagcgtccaggtatcgttactcacgtgtatatctccctctttctggtctaaactggttccaatgtcaaggacaattttttgacagtaacagatacaaaataaccaccgttactggtgaaaaatatgcgttaagcgttatcacgttaaaaagatacgggaaggccaactgaccatttgttttttgtcgtattataatattcgtagaatagcactaaatatggggtgattaagattataaatatccttgacagaatcacccaacttcgtttagaacggaagcgtaagcacagcatggccgccatattaatgccggccatgctgtgcttataatagggggtgtttttttttgcagatttactaagtctgttgcggcaacggggttactgggttcactctatcgcattgataagtatcacaaaggcgaatagagaaagtaccttaaaaaagttcacgcattttgtaaatataagcgagttctggatgggctccccagttttctccattgtatagctgcaaaatcaggtcagctgatgcggtcatcaaataggcccttgctttttgggatagttcaagaatttctctcagatgggatatctgttgaagcgcaagttctttggagcgggtccacttcgctatttcgcggcgcaagatgcgttgatcccttgctatgacgaattctgggtcctttttctttccttgagccatagcgcgtttctttgcgctggcctctctgtactttttggccttctcctctgccgcgcggcgacgggcggctatcaacgcctggattggcataagttctgtcgccttgatgccgtagtagttgtccaccgggtagataccagtggtaacataggtgtagtattcagatggagttagccccgccagcgcatattggtaatgtcgatggttataggcatcaatatagccgctgatcatccggcttacagttgacgcgtctggacatagcgccacgaggtcaagcaattcacatttcagccgtccgaaaaatgattccatgggggcattgtcctgagaattgcccctatcggaaacagactggagaaaaccgtcatctgacagcagcctctggaatgtggtcgagaggtactgagaaccttggtcgctatggatcacacatgcagcacctcgcagttcgtgtccatggttctccatcataacgtcataggcggacttgacaagcgagactgtcatgcgggaggacacgcaatgccccaagatctcttttgtataagcatccttaaaagcgcaaagataaatcggtgtacgcacagggccataatacaaataagtgatatctgtcaaaataactctgcggggaccaacggagaaattctgtttcaccgcgtttttcggggaggaatattcgtgattgtgtgtggcctgattcttataagcgtccttcctgggtctgttggccacgagattcatttctttcataacctttcgacagcgttttatactgatactgatattgaactcgcgccatagatgggtctgaaaggtcctttttcccggaacatatccaagttttctcacgattttcctaaacttttctttcaattgctcctgttgttctttctttgcggcacaggagctgtctatatcttttttacgcctgacccacgaatagtagccggatctggacactccaaatatgtgaaggcattgcacgatagacagaccgtccgctctatccgcttgtctacggataaaggaatctaccatatagaaacggtcggcgcttacaccttcggattcaatgatatagttgtgtcctccaatgcggaacggagttttttttgagctgcaaccagctcctccaaataggcatttctggctttcagataggccagttcttccagaggggacatggcccccatagcctctctgggtacagagccatcatagctggagggatctgcggtgaacaaacgaccctcccggcccaactgcatcgcccgctttcctgcggaattcgcgcggtcctctccgagtacagcggtggaaaacccaaggctgttatacgctgccacataggtcatatgctcctcggagatcttcttatacatggcaacataaaagtccttcgtgtaaataatatcccgcccacgaaaatcctttaggaacggattatccagaaacggctgaatctcctctggcggctgcctggtcattctgttttgtttcatattccctcatccgcccacctttctcatactcctaaattttttgcccgttcaatggctcgttgggcagctttttctttcatctgctgatacttttcttcttcctttgcgatgtagagcgagaattcagcttcgttcatggccagaagatactgctcgtactcgactggcgtcatgcggcccttatcccacatgcggcgttcataattgtaatactctgcatatcgcgcgacaagttccctcaactcctcgatatctttgcattccgaatacggacactcatctttaaaatgtccaaagaaagactcttgtggggcgttgtcctggcaatttcctcgtttggacatcgattgtgtgtaacctcttttgcttacttcctgctggaatgcgccagacagataaactgtcccctggtcagaatgataaagtccaccgctgacacatgggtgaagatctgattgacgcagtgtggcaagcgccagttccaagtcattgtgttcgctgactaaaaacgcaactaacttgctggtgacgggatcgagcagtgctgagccatatgccttgcatccgtcgccatagagaagatgtgtaacatctgtcagccgtacttcattgggccggtaaaggcggaatctgcgctgcagcaaattaggtctcacattctttttcagtgccgctccacccatgcgcttggaaggcgctgccttccgaatcgacgatgtgaggttgtacgttttcataatacggcgtatctttttcagccccatacgctttcccgtcagagctggcatcatcatatagatctgccttgagcctttggcaaaccccttgtattccataacggttcgaatcagttcggcatcctgctcgtcttgtgcgtttctctgtactaccgactgtccataggtgccattcttcagtatggcataatatgacgcacgagaaatcttcatgagagagagtatttttctaacgctatactttcttcctgggtctggcggaagatcccggagccacaggcagagcgatttcttctgcagaacattcagagaagaaacaatatctccaatttgaagaaaccctttttctacaatactgtccaatgcccgcatcctatttctaaggattttccgtgtgggagaggcgtttattgtctctccgtcagccggtgtagcccatgcagccaaaactcggctcatgcgatatcgctccgttactgaaaatatctccgggtcaatatcaaacacacggaggatgtcgtcgaatgccagtactgcaataggtgcggcagcctcaaagaatgccttattcaactctattttttcacgggtggctgtttggacataaggatgtttacgatactgctctaccgtggcggcagtataataagctgtacggccccttgtagcactgcggtttgtgtcctgcccagatgaatgttcaaatttttcttgcagccagtatattttgtggtagcccatgtctgctggcgaaatcccagcggacagcaaaccatcttctatggactgttggggatagtttcggtatagctccgcctcaaaatccggatgtaaaatcagtctgttgacatcccaaacaaattttccgctttcaaccaattcctccgcagtcatggttggcatatatattgttttggcccagtttgcctgggtttccggcgatgcctttgaaaacttcggacgcccaccccgtttaaaaacagattccactgactttgtgaagtttaggccaaggcgctgggtatcaaatccgtttgcctccagcatccttctgacagttgaccgctctggcctccgtatccacgcctcatagacctgctgtctgaactctattgtcagcagcaaacggttttcccgcacctccagcacatttggattctttttcagggcttctatttcttcaggcgaataccgtttgggaacaaatttaacagccattttccacccatagcctctgtcctattttgcacgatgatcttgacctctgtcaaggcagtgtctacagcgtttactcttttgtcaaactactgtctattttctgtgtaccactgtcaatctctggtctgtctttcgtgcttttttgtcagagtactgtcctttctataggtaccattttagtcattctctgtgtttgatctatcttccagtgtgaccttctttggtgggccaggatgaaccggggcccggtccagcggcagggcgcaccacccccttggcgggcatggtacgatttcggcacggggatggggctacatgctctgccccatagtcatggcagggccagccatggtctgcccctgcaccagatcgtcgttccagtccttatgcacagggagcaggatgccgctgtggtatcctgcttcctgcaactcttcctggatgcgcttggccgccgtctgtccgggctcgtcgtgatccaggcagagcaccacatcccggaggcgggtgttctgctccagcatccaatgcatggcctggccgccggtaccgcacagggccacatagctgtgctcctgccatctgtccgggtacagcgtgaggaagctcagcagatcaatcggggcctcaaacacatagagcaggccgtcctgccccacgtggtggaagctgtgctggggcctgctgccttccacgttgaccttgaaagacttgccctggctgttggtgctcctcttgtgggcatggcggggaacaccatgctcgtccgtgcccacaaagatgcagttgtggtattgagcatcctcgtacagcaggccggaccgggcgaagtgggtgaccacctcccggctaacgcggcgctgtttcatcaggtaggcgtacacacggcgcatatcggcgttgggcggaggcagggcgaagggcttaggcggctcctcccgctttggctctgcggcgggatatgtcgcgcccaattcattccccaacaggagctccatggcctcctggtagcttgttccgtaaaagtgctggacaaaactgaccgcgtggccgccccgccgggcaatatggtcgtaccattcgctgccccggacagtaatatgacggatcctggccagccgggactcccgcccagcgcggagcagcttctccccccgccgccgcaggaactcctccagatcaacggagttggcctgctccttctgttcagaggtaaagtggatataggttcccgtgagaaatcacctcggttttggttgctgtctttccctggattgtgtaaaataaaagaaacagaatttgactgtgccaggaggctgaccatgaacaagcaggatgagattttaactgtcagcccagagcagacctaccacgccatccgcggctccattgtgactgcccagcactccgtagccaaagcggtcaactccgccatggtgaccgcctattgggagatcggagagcagatctacaaagcgtgtggagaaaatgaccgggcggagtacggaatcaggctcttagaatacctctccgcaaaactgactgctgaattcggaaaaggcttcagtgtgcaggagctccgaaatatgcgccagttctattgcacgtttccgattcgctccacactgtggagcgaattgagctggtcccactaccgcctgttgatgcgtgtatcagacgagaaggcacgcgcattctatgcggaggagtgtgccaaatcggcctggagtgtgcgtcagctggagcgccagatcaacaccatgtattaccagtggatcctggccagccaggacaaggcgtccgtcgctgcggagattcagcgcagagaacccaagcctgagtacgagaagatcgtcaaggatccctatgtcatggaattccttcagattcagccggatacccatgtctacgagagtgatctggagcaggcccttattgatcacctccagcagtttctcctggaactgggccgcggcttttccttcgtctcccgccagaaacggtttactctggacgggcagagtttctttattgatctggtgttttacaattacatcctcaagtgctttgtgctgattgacctgaaaacagataccctgacccaccaggacatcggccagatgcagatgtatgtgaactactacacccgtgagatgatgaatgaaggggacaatccgcccattggcattgtgctgtgtgcggagaaaaacgacgcggtggtacgctatacgctgccggaaaacaacacccagatcttcacctccaagtacaaaacctatctgcccacggaggatgagttgaagcgggagcttcgactcgactcctttcacaagttggatgaatagttgaagttggggcttggactgatccgagccccactagttcatccgcagttcctcatggtcatccgccttatgtcctagggccatacgcttctcccggagcatccggcggcgcttcttgtcaatgtgcaggccagtctggatggcatcggaggcggactgctctcggaagatgcggcccatgttgtggaatagctgaaggacacattgggcggtatccgcgtgggataccgcccaatgtgtctgtgtacgctggtggtgcgtgaccttctgctgtgggtgatatgccccatgcggcataccggattgtgcaggcggtgtgccagatggggtaaacccgtgtaccacctcatctgttgtaggcggctcacatcgccccagccggagcatctcccgtatgatcatgttgcgcacggccttgaactctttctgtttggaaaggggcaggcgctccggcaactgctcggagcaggtgcggcacacctcctcccgcatctggttccacaggtcataggcggccgccacacgctcgtcctttgccagctcatccacgattgcgtccaccagtgccttggctacgggcggcaggtagctgtacacctttttgcccttggtgttctgcaagcgacgggatagttccagaatcagccgctccaaattttcgttttggagctgaccctgttccatctgcgcaatcagctctgccatggcgcgctccgcatcccggctcagggtattccggtactcggttttctgttcgtagacgtggagcagatcctgttggaagatccgccggccgaaggcggacttcacctgctggatgccctgcttggtgaggtagccctccttgggatcggaggagaacaccaccatgtggatatggacgctgtcctccttgcggtggaaggcggcgtaccagcgcaggtattccagcgggatcttgtaccccctggcgatctccggcacgcaggcacacaccagctgccgccagctctccacgtcgttgtagcccagccgctccgcgtcctcccgacggatggccaccaccggcgtccacacgctgccggtgtgctccgccacctcccggacggcctgggagagattgcgtaccttgcccccggcacaccacaggccgtgctcaccatccatctgcacgccggggcggtgggacacgtagtccaggtagttctccatccggctcatgggctccgcgaagtcctcctgcacttggcgaatgaaagtatcggcgtttgcctgggtgggtgcgttctggtagtcctcgtattccagcagctcctccgcaccggggaagtcacggaggaggcgctggatataagcctgctgctttttcgtagcaggctggccttgttgttcacccctgagtacttccacgccggggcgggtggcgatgtagcgggcccggttggatagcttggctgtgtcccttccgcccttcaggtagggggacatgaaccggacgcggctcattcgccatcaggaaagatctggcgctggaggtctagagcgtcatcaaaacggatcttcccgttggtgcgcagcacctcgtccaccgcgtaggcccgcagctcccggcggttcaccggatctgcccggaagtgggcggccacggtgtggcccatcatgttgacctccacacacagcttgaacagcagagtgcgcagccggttctcgttgtccgccagcgtgccccgcaatgtgtccaccagagcgcgggagagatattccgaggtgtcctccgtggccaggtagcccatgtagaaccgcagggccttttcggcaaattccccacggcttttgcagttgtcctcctccagccagccgtccatccggcggacaatgcccggcttgagccagagggtgattttcagcctgttttcctcgtccatgcttcctccttgttcaccacggcggtgcaaaagggcctcaaccgcctgcaacgccgtgttttttcaaacgcaccaccgctctaaaacccggaacgggcctttaccgacggcggtacccaaatccgggaaaagccccgcactgcggggctttgtggcctgagcgccggggctcaccacggcgctcctttatcctcgtactaaaatcgaacgccccaaaccggggcgaaactggccccaacggggcggtttcccgtctgggcggggcccctggcccgccctccttctgaaaccggcacacagggcgcacacggggccgacggcgtgctcacagctgggccaggctgggggcctggcggggctgcggttcctccaccagataccgggcccggaaatctgccagcgccatgccggtctgttccaggcagtaggcgtccatcttctccagcagcgcggcctgctcctgcttggccagcggataccggaaggcgaactcattgccgtctccgcacaccaggatgacgtctagtgcggagcacggccggctggcgttcaggtcataggcggcgtacacgttgagccagtcgtcgttttccgcggtcgctacgtgggtgccaaagaccgcgtccgggtcaaaggtcaccggcatatagaactggagcagcccaccgcactcggacagatcctccgcgaagccaacctcccccatgggcagccggtgtgtcccgaccgtgagctccggcggctcggcttcctccgttgtcagcagatgactgtactgctgcgccagagaacggtcggtgcgccgctgacagcatgcctccatctccccgcgcaggacgtctcgctccgccctgttaagcggatacaggaacggatgcgccttctttccaaaattccggcagagggttatttctatgtggtccgccacatcctgaagcgcaaaatcataggcagtatggaggttcagccagtcacacagtgaactggtatccagctccgagccaaacacctcctgctgaacttctttgctgacacagtcgagctggaaatccagcgtgtggccgatacgcaggatctcctccgggaacaccaaatccccctgccgcagatccctgcggtgggtcagtacgggaacactcacaggctcatccctcccagtacaggcccattctgctccggcacgctgtttacctgggcctgctgttccgccaggcagtccaggatctcctgggcctgcgtgtccagaaggacgtcctgttttgccgcccacgccaggtagccgtccagcttcataccccgctccagcagggcttccgccgccgcctgcgcctgcgcccgcagacacacgttcatcgcctcatagtcctccggctgcacccgcaggctgtcccttagcagatgtgctaccctctgctcgtcgtatgcagcgagcagagggcgcagcaggggggcggcctggtcacccggctggaggcccttttggcgcagctccgtgagcatgggcagatcatgggcataggcggcgccgcacagcagcctggagggtgcggcggcaacctgctccggcgtggcccagcggataagctctctggccatggcgcggttctgcccgaaggcgtaccggagcacctcaccgggcagggcgggggacggattggccaccttgtccattgtctgatccagcatcatctgcacccgctggagatccccggtgtccaccgcccgtttgcaggcatccaaccagacgtcctccgggtagggtgactttgtcccaagcatcagtctggccatccgtttgcccactgggcctggcctgcctgccgctgcggccagcaggctgccccgctcttccggcttcgtgatctgaactgccagggaggaaaacgcatagagctccccatcccggatggccagcaccgcccggtccgccgtgctcatgcgcagggggcgggcgcccacctcgtccatataggcggtgatgctgccggtcatacggcgcaggagctgctccgtattcgtcatctgtgcctcctgccgcatccgctgttccagcagcgcatccatgagtacccgttgctccttcggactgagatggagcaccacgccctccgctttcgtgctgtcttccatctgccggtatctggcataggcaccttgctcaccgtgaaacgccttggtaatggcggaggagatgaggaacatccggtccatgtcggagccgctctcgcccagggtcttgcccgtggcgaagcttttgatcacaggcttgccgtcctccccgtaccacttcaggtacacatccaggtaaatcccctcgctgtccccgtagtccgtagtgcagaagagatccgcattcctggggatcacccttctgtcctcccagtcggcgtccagcagaaaatactcgtccggcagatagcccatgccctccaaccggtgcttcagctcctcatagacctcctgtccagtgcggccgctcagttcaatggtctccatctgtcgcttcctccttctgcatctgtgtagccttggatgccgccggccgccgacgcctgtcccggtccggccggcaccgggcgtccaggtaggcccgggtctccgccggtacataggcctcgtacagctcctccagcgcccgctggagctccttctggggtgtgcgcttgttcttagcggccagaaaataccggagcgcgtccagccgctccggttccatgctcaccgtcagttctgttttttccatagtcagctcatgcctcccatcgcctgcattgtgtttttcggaacctcggatgaaactgcaggctgcccgcatagggtgttccaccgggcctctgcttcacgcagataccgctccgccagctcagggtgttcccccagcagagggcggatgtgtgggaagccgtagtgttcctctgaaacgctgcggtcatagctccccagcacatagtggagagggacgtcgtccatcgggaaaaaacgtccctgtacggagcaggttttgcgttccgggtcaatggactggatgacgccgccacggagggcaaagtctccaggaccgccatagggttctgtggcggcaaagagcaccgtgtctcccacggacagctccctggacagcaaagcgtcccgcatctggtcgatcagtgactcgcggcttgtggagagcagcttggtctccggagccagcagggcctgtgcctgccggtaaagtgacgccgcctgctgctccgtcacccccggcctccatgtaccatctgtccgggtgatccgttcgttgtccggcagccccgccgccgtttcataggcggcaataaggcaagccgtattctggattgagttcatattctctcactcctcgtatgatgtggttggcaggtagtatctggggtttgttctctgtccgctgacccgcacctcgaagtggaggtgggggccggtggatcggccggtgctgccggacagagatacgatgtcgccggcctccaccgtttggcccacccgcaccagcagttgagagttgtgggcgtagagagtggacaggccgttaccatggtcgatcatcacatagtagccgtagctgctgtggtactgggcggcggtgacggtgccgggcagggcggcccggacgggggtgccggtgggtaccgccaaatccatgccggtatgaccccgggtctccccggtgaaggggtccctccggtagccaaactccgaggtgacccggctctcccagcccgccccaatgggggagcagaagccgtccgccccgatgaagggcacgtcggtgccggggatccagccctccgttccagtagatgcaccgtacttcacgacattgtaaacgctgtccgcgttggcctgctgttccggtgtggcttccgctccggtaagatgccggatgttttgccagacctgctggaaatctgagattgagacggccacggtataggtctcatgggtctccacctcattcccctcctcatccacagtggtcaccgtgcgggtgcgctcctcataggtgacaaagcaatccacaaaggcctgcccggcgtgggccgccgggtcatccgcgccgaagtacagagcgaagaacaccgccttgactcggacatcatccaggccgtccccgtcctccatctgcccctctacggtctgcatggcggcatccagcaggacaaagctgtcccgcatctcctggatgtatgcctgatactcctccggggtgccctccgggacggccccgccgtgaaagcacagatccgccacagtgcggttgtgttccgccccacctgagaaggtggtgcagaagaaggccagaaggagaatgatgggagagagtacggctatcagcacccaccccacggccttccggctcttttcattggcgagaatagatgcagcagccttgagcaccagggctggagcggccattatcctccgcctcctgtgatcagtgcatgcttgtggggcggggcgtggacgtccagcaggttgcggtccgcaccggatttgaacaggcagacaccgttattgggggaactgatcaggtcgtactcggcactttccagttgcaggttgtccatgtagaacttcttgtccaccttgccgccatggaagagaaactggtgggtggggatggcaaacagggggcgggtcagctcccgcacgccctggatatcgaaatcctccaggttttgcgacgccaggatcagggcggaattgcgcttgcgcacccgcttgaggcagttacggatgtactcaatggtggtcaggttggacagccagaggtagagctcgtccagggcggccacggtgttgcctttggtaaggagctggtcgctgaggtaggacagcaggttgaacagcagggcgtccttgacggaggagttggcatggatcaggtccttgacgccaaacaccagaaacctagtgctggtgatgttcgtgcggccgttgaagtagacgctctccgccccccggcacatggagtggagccccagcaggagctcccgcagcagctccctgggatacagagggctgtcctcctggtcatagtgctcgtaggcgtcctccaggacggcgtacagatcctccgcaatgggccagtcctccggccccatggcagagaagtccgccttgtccgaaatgccccatttccggtacagctgctccagcatcagctccagggtatccacctgttgctgggtgaagggcttgtaggcccggaaaaagtccttgaggaaggagatgtgctgggacagggaagatttctgccggaatgcctctggcgcgtctggattgtcctctccatccacatcccaccgcttggcctccaaaaagttaatacggaactgcccgcccatgaggtctgcgtaacagccacccagtttgccacagagccaggtcagctcctgctccgggtccaggcagatcaccgtcttgccgctctccagcagattgcagatgagcagcttgagcaggtagctcttgccctcgccggagttgcccaggatgagcacgctggagttggtcttgtccggtgtgcggcggtccaggtccagcaggatatccgcaccatagtggtcattgccgatgtagaacccatggggatcgctgcggccggagtagttgatggggtacaggttggcggtggagctggcgggcagcacccgctcaaactgggcgcccagggcgttccgccccgccgggttggcggagaggaagccctcccgctggcggaggagcagggggtctgcactgagcttggcccgggtgagctcggcgcccacctcatcccgcagcagccgcagctcctcggggcttttggcggccagctccaggaacacggcgcagtggatgaggggctcccggttcttccgggcgctggcaatgatggcggccacatcctgaaggttggcctccgccgtgacactccgcttcaggttgtcctgattgctccgatccagccggttcttgttgacggccttgtggtagatggcgtcctcctccgccgctgtcacttggcgggcgtagaggtggagggtgacgccggcccggttgcagatgtgggagagcagggccagctcctcggtgacggcggggtaaccccggagggccaggacacagcggtacaggccgcccagcacgtaggagtccgtgttgaacttcacggctgctggggcgatcaggtccaggaagtccttgggctggtgcgtctccaccggtttttccaccggctttttccgctttttctgtgctttagccatgatcggtcacccacctctctccatccacttgctcaaagtgctcggtgaccacgtcctgctggtagtacaccgccaggatgcgcttcacgtcctgttccccggccaggcaaacgtgaaagccgtgatcctggatctgcttctccaatcgccggggcagctcccgatcctctgcggccttgctgtccagccggcagaccaggacgaactcccgggaggcggcggtggaggactggcgtgcgtccaagtgctccatatcctgccggagcagctcccgcagggcgggagacggttcctcctccagcctcctctggtaatactgcttgtttttcagaaatgactccctggagtccagggccagcagctccagggatgccatcccctggagaagcccggtgagggcccgcacccggccccggatacccttcggggacaggatggacaggttgtccggccggagcaggtagaagagcagttcgtccctgccgcacaccgcgccgtgctccgtcaggcgggtgacacccatgagctgccgggtagtctgccgctgacgcaggaactgctgttcctttctattcattgttctgcccccattcatagtattgctgctgcaggaacaggaagcaggccgcccgccgcaggaagtccaggacgctggagccctccacctggatggcgaggaaggcgtacagcacggtacccaccaggggcagcatggtccccgtctgggccagcgccaatacagagagcagaaaggccaccccgataatggccacgtcccgcagctgccacagccacagggtggccttggccttcaggttgtctgggtagatgaacacgaaaacacctccaaaacaggaagggacccagcctgtccggccggatcccttcctgcagtttatccttctgtactgctttcttccgtatcctcgtcacatccatctgtttccccctcggtctctgcaacggcttcctccgggaggcggccctcctgctccacgtgcccctcgttggcggtatcccctgcagccttacattcctcctgggcctccgccagggccctgtggatgcagtccaggaagaaggcgttctgcttgatgcccttctcctgcaggtagtccttaaatcgctcgaacagctcgccgggcacctggaatgccaccgttctcttgtctccgctcatcgtagtttcctccttctgattgtcgtaaaatgtttggatcaaccaggccatatactggcccagtgtttttccggatacctcctgctcctcccgcacccgggcgtgaagcccggcggggatgggtgcacagaggttcttcacattttcttccatggattggccccccttctgtttggtaacgcaagtatatcgatcccggcggtaaatagccatcaccaacagcaacaaagattttgccggaaagcaagcataagcaacaatgtcagcccccctccgccgcccgggcgatgcccgccatgatatactccacgcatggcactgggacactattacccaaggccttgtaccgggcggagtccgaggcgccgggcaggtctgtccacccatccgggaacccctgaagccgctcacactccagtggagtgagacgccggatcaggaaaaccgccagtgtatcacggcttggctggcagatcagatcggtggcatccttcccctgacgggcactctgggtggaggcggtatcgtcctctctgaatttgtccacccgctggcggcgaaaaatggcgtgccggtccgcactggtcagggtataggccacatcattttggatgccaatgccgttgccgccattgcggggctgccggtcaatggcattgccgcagatacacatagtcggctccggctggagggccagaggcaggttgttgcctccggtaccagccctggcggatagtgtgggcacgatcggatgcggcccagtgtatcggctgtcaatgccgtggttctcaaaaaccaggggctgatgcccgtgctgttgtgcccgcagggttccggtcttatcttcagtgcagtccatgacgctgccgccctggtcgttgaggcagagcacggagggcatgcggttgccgctctggccggccttcagggtgggcgccgcacgctccgagtatccaatactgcccgcgctggcccccgccccggcggaaaacccggctgtaatatcccgggtatccgccaggccgcactcatcccaggcggccagccccgcctgcaccaggagggccgcatggagctggggcgggagaggcttgccccgctccttcgccctgcgcagaatgcccaggcaggctctcctggtcaaatagtattttcggggcggattgtccgacaaggaacaccctgcgtctccgctggggggtgccgggccagtattgagcgtcgaagaccttccacgccagggagaatgcagctcccactcgtaatttcccagcaggttgccagccccaggggtgaggtcgagtgaaaggtatggaattgtctgcaattccggcgatctgttccaggacgaaccggaagtcctcccctttagggaagccgctgctgaacacgccggggacattctcccagcagaaccatctggggcgaacagacttgcctgtccgccctcgtcgtatatccgcatcccgcatctcctttgtcacccggatctgctccaggaacagcccggaccgtgcgccggccagtccggcgcgggtacaggatgccacggataagtcctgacagggtgagccgccgcagataatgtccaccggcggcagcttcgccccgtccagcctggtgatatcccccatatggagcgtctccgggaaatgatgtttcgtgacttgaatggggaagggctcaatctcgctggcccacagtggggtgatcccctgccgtatggcggccagcggaaagccgccgatgccgtcaaacaagcttccgagggtaagggtcattttaccgcctggacaatggtgcgggtggtattgacggcagcctgggcggtgtagacggcgctcatgatattggctctggtggtggtgtccaggccgaaggccccggcgatgcggggcacctctccggcggccagcatgaggccaagccccaggagggctttgtcgctgaacaccataagccccgccaccagaatggtggcctggaggaaggcgctgagacacaggccaatgacctgcttgcaccactgggtgaagccgtccgtatagccccgggggatggagaacatgtacagggagcccaccgcgatctggatgagcaggatgccgccccgtttcaagtttgagaagaacaccttgattaccgcataggccatgaagatcatggcgaagaggagcatgatggggttggtacccaggccccatttggcctgggccgcgatatccgtcaggccagccccctcaaggcctgtgaggatttcattgcccagctccccgatgctctttcccgcccctgtgatttccatggcgaaggtaccctggagggagacggagagggcgtacagccgaacgggcacagtggtgaacaggctgacggcaaagaagcccttgagggcgttgagggcgggctgctggagattgccccggccagatgcgtactcaatgccgcactcaaaggcagataccaccacgctgacggcaaagagggcccagcccagttgggagaagaagcgcaccactgaccgcacccaggagaggtcaaacagctccacccccatgtttcccatctgggcgaagaaggcgcccaggaagcccaccatctggctgtaaaaccagtccaggatggactccatcaccggattggccacaaagtcccaaataaacactcgccttcaccgcctcagatgcctacgatattccagatgtaattgggggccagcagcacgaagatcaggcagacgaacaggatggccgcccccgtccactcaaactggccgtgcttgcgatagtcgaagaagcacagtgccaccttgacaaagaatgcaatccccagcaccatggtgagggcggggaacaccacagtatccaccacggtcttaatctggccggcggcatccgtccaggtctgctccacggcgtccgccacattgccggcggaggaggcgaaggccgggaccatgcacagggcggccaccgtcagggccaggagcagcacccggatgcccttttttctgatactcattctgacacctccataaaattggagggtcgcccgactggggcggcccttctaacgatagtttgctggaatcaatagccggtgcggggcaggggctcggcgggcttgtagaccttggtcacccaccgggaggtggccataatccactggccgttgtacacgccgcccacatccgcctggttgacgaattggctgccaccggtaagccaggcgtagacggtggcatagacctggggcgcctccacctgccggaagttggcgggcaccacgccgaaggacaccatgaattcggtgacgtactcgttggaggccaggcccagggcggccctggaggcgtccaatacatagttctgctgggtgctcaggttgtccgccaaggtgcgccaagtgccgccactcaggttggtcttgtagaccaccttataattgcccggcacgttgtaggtgccagtgacaatcttgtccagccgcaccgcctggccgggcagagtgtctcgccaatagaacgatgtaaggctggtggtggagttgttgccgatgcctccgaaatcgtagcggatctgttggccgggcatgacctccacatagccggttttttggatgcttacattggtgtagaggcccttgttggtcatggctgcctttacgatctgcccttcaaactcaatctccacctcgatgggggtcttgtccaggccgtaaaagtctgcggccttggattccacgattttgtagcggcccagggggagaggccgggaggatgcaacgccgttcttgtccgtctcaaccgtatcgaccaagttgccggtccgggcgttgtagatctcaaactctgtgccggggatgggggtgccggcgggccagccgttgacactgttgtagtccgcggaggtctttgttatctggatctgtccagtgatgggggtgttctcccactccacctcggtggtctccccagactccacatagacggtctttttctccgtgtcaggaacatagccctcattctctaactctctgagataataccgcccggcctccagaccctcgatcagtacatacccctcgttatccgaagtgtactggccaacgggggtgttggtgctgtcatagaggataaacggcaccccatagatgccctcgccggtggcgctgtccgtcttgtggatgaggatggcgctgaccggcgtattctccacctggagggtggttgtctccccgttctccacctcgaaatagtggggcgtatcgtccatgtggaagccttccgcgctctcggtttccacggcatagtacgatccattctccagggacaggaacacccggccgtttcggtctgttgtcacggtacccaccagggcgtcgtccatacggcggatttcaaatgtagtgttgggaatccgctccttggtgtcatccgcgttgaccttgatcagctccaagccgcccacagggtcgttatacaccgtgatggtctgggtgtcgttggggttgatgaccaccgtttgggtacgggtctcctcatggatggtgtagccctcgatggtcttggtttccgtgatgatgaatgtccccaccaaaccgtcaatgatgatctggccgttttcgtcagtgcggtagaggcccatgctggaggtcatgccgccgttgtcgtccaccaccgtgccgtccgcctcggtgatggtaaactctaccccctccaggggctcatgggtgacggaatccagcttgttgatgacaaggccgcccttgggggtgttggtgatgaccaccgtttgggtatctacaccctccccgatgactacattggtggagggggcgtccatgacgtacccatggggcgccttgatctccgtgagcacgtatgcgccgggggccaggttggtgatgcggatctcaccgctgctgtcggtggtgaaaataccgttctgggtgagggtggaatcgccaattaccccgtccagtcccacctcgcagccggcggccgtcgtcactcggaactgggccccggcgagaggctggcccgtggcgctgtcccgtttctggatgatcagctcacccttcggctgattcttaaaagtgaggctgaccgtccggccctctttgatctgcacggtctgggcctgggtatcgatgaggtagcccggaggggcctgggtttccgtcaccaccacgctctttccgggctggaggccggagatcaggatctcaccattttcgtccgtccggtagatgccgttggagtccccaatgagggtgccgtccgcataggtgaccttgaactctgcgtcaggcagggtcacgctggggttggccgagcacaccttgcggatcaggaggttcccgtccggcatgttttcaaagcggacagtgatgacactctgctccccgttgtctgccaggtagacggtctcggaggactggatgatgctgtacccgtccgccggatccacctcctccacgatgtacgatcctggcttcaggcccgtccagatggccatgccgttggagccggtcaccttctgtccaatcacggtgccgccggtaccggaggcgcctcccaggtagcggagctggaaggtggccccgcccagggcctcgccagtgacgctgtccgtcttgtgtaccacgatggcgttgagggggacgttctcaaatgtcagagacttgtttccgccgccctcaatatagacctcctgggtggcaggctccttgatggtgaagccgggggcgggttccagctccgtcacccggtaccagccgtcccgcaggccctccaacacgatctggccgctggcgtcagtgaagtagatccccaggttgttgagctcgccggtgtcggtgccattgctgccgtaccagagctggaatttggccccccggatggggctgccggtgatgctgtctaccttctggatggtaagggtgggctttttgtggttctcgaaatagacggtgtggttccggttgggatagagggtgaccaactggggctccgcatccatgagataaggggagggaaccgatttttctgaaatttgatacaccccgggcagcagattttccagggtggccgttccgtctgccccggtcttgatttcatccacgctgtggccgtccgccgcttccaccaggaatacggtatccggcacgggctccccggtgtcggcatcccgcttcaccaccgtcaggttggggcggatgtcgttctctaggatgatcgtggaggtcttgccggggaacagctccacatggcgttccaccgggtcgctgatgtggtctgaggtggtgtccagctccttgaccgaatacacccccggctccaggccggagatcaggatctctccattttcatcagtggtacggtccagataccggctgccgtcctcgattttggcgatgcggaaagtcaccccagccagccgggaaccgtccgcactcagcttgatgaggtgcagggagggctggacggagttggtgaacacaaaccgggctgtctggttggcctccagttggatgatgcgctgggcctcatcaatgatgtagccggggcagtccagttccgtcaccacataagctccggtgggcagttcagacaggtcgatttcgccgttttggtcggtaacaaattccgccgggccaaagctgccgtccaccgcctcaatgcggaacttggcgttggggatcaccttggaggggttggcgctgtccaccttgaccagccagatcccgggcttctggtcgttaaaaaagtagagctccttaatactgtctccggccttcagttcaatttcctgcggggtggaatccgccagatgtccactgtccccagtgtccacctcttggacgcggtaggtgcccggccggcagtccgtgagcaggatttctcccaaagcgtctgtctcatagtcccccagcaactccccatcccgccaaatacggaaggtgacgccgggcatggtctcatggctctctcggtcgtacttgataatcttcaggccgggcagggcctcgttcttcagggtgtaggtgacgcagtctcctgccaccacagtggtggtataggtctgggaatcccgctcccacccctctggagcggacagttcccggatttcgtatgcccccggcttcagctccgtgaaggtataggaaccgccggtgccggtggtaccggtataggtcgcgccgctctcaatgtgcttgatctgaatccgtgccccggccaggctggccccggtggaagcgtcgatcttctcgatacgcaggtcgccgtagggttcattttcaaagtccacctcggcggtttccccgtacttcacggtgacctgtttgaccggctcctcgtccagcagatgatactccgggggtacccgctcatagatggtgtaattgcccacttctgtgagagggatggtgatggaaccggactccggcgtggtgtagacgccgatggtgtccccgtccgggcccaccacctcgaaggtggcaccggagagggtgacagtagtgcccgcctcatacttggtgatcttgagggcggtttcgctgggagggggcgtaggctcgtctgggtcatccggctcgtcggtatccgaatagttagagatggcgtttcgcagcaggctgaccttgggatccgtgtcgcagaggtaactctggaggttgccgtactggtcaacctcctggcaaagcgcgtaaaatacgacatactggtacacatcggctgagagggagagctggacactgccgctctggcccgctacgcagtcctctgggtagagcaccttgaaggtccccttgtagccgtctccggtattggagaccttgacctgggtaatatcctggttgttctcatccacaatacgggcgccctccggtacgtccgtcccatcctggaacgatacattaacagcctgtccgtccacccaggtcggagaagtgacagtaaatacctgctggcgataggcggccccatcaatggtgacggggtaggctgcctcctgatctggggaggtggtgagctggggctctgccacactggtccatgtggtaccctgagtatagattttgaccgcggcattgagaatgctttccccaatctccctctccgggccggtaagtccgggggctacggtgacgtcgctgatgtcccactcggggatcaggtaacaccacagggcaatcttgccagcgtaaaatgcctggtacttgttggtcagacccaactccgccagggagcggtgggggtacatgttggccaccaggcccaccactttagagtctgacgctttctcctccgccagatagcggatgctctccccttcaggaaccgtctgtggtacgccgtactggtctggcgttacacaataggctgggatttcctgcgtctccccgacgctgttgcggtagagaaagtaggtatacgactgggtctgcaccctgccgttgacggccagataattcatggagtagccgccgctgtaaatgttgacctcacccagggcctcctccggggtggaggcggcacccgccggcaggatcagcagggacagggccaccgccagggtgagcatcaggctgatgattcgtttcatttgcaaacttccctcctaagcaaaaagcgggaggcttgccgcctcccgccggtttgtctgggacgctgttaggtcacgtccctctgatattatattcggtatagagatatttcccgtcgtggtacacatcccaggcttccacctcgaaccgggcccccggcgcggagcagaatacttgggtaagctggtcttcctgccagggccagaacatctgcaccgcgttctgtgcagagatgcccaggtgcaggttgagagcgggggcaccatccgcccacagctctggacagttcactgcggcgttgtagatggtgtactccatccgccgggtctcatagaggtttcgaatgtgcaggttgtccccatattcactttgaaaccgacgcacctccgccttcggcaactccagctccgggaagcgcgtctggtcataggcgggcaggggttccggctcctcccacagacgcagatccgtgatctcataggtggtgccgtcatcgcagagcaccttgtccccctccttcagccggaggggctcgtccgactgggggacgatgaccaccccggagggggcggacactgcactttcctctgtgtaaggagagctggtgtctaccaggacacggttggcgccctggtcatacgccacgccgaagtctaccgcccggccgacgtcccggagctgcacatagttgtgaccattgatgacatacgcttccagatccacctgcttgccgtctacatagaaggtctgggtgcttggggctgcagtgagggcagccacccccgccgacgcgggccccaccagtgctgcgcctatcaaggtacctgccaataccgccggaataagctgtttccttttcatacggttgacctccttctttcctctgctgtccttgtgttccttacagcaacaacataccggaaatctggggaaaagtctatagcaaagggggggcccggtggagaaaatgagcccgcaaaacaaagcaggttacacaacctccgccgcctgcacctgccagcggtaggtcctctggttacgcacgcaggtgtagagagtgagcttgttctcgttggaaggggcggtgccgctggtatccgtctccttgaccttctgcacactggtgacctcataggtgcggacacccagcttggtggtccaggtgatggtatctccccgctccagggtgtggagatctccaaagtcgtcccgcaccccccggttgtgtccggcgatggcgcagtttccatcccagatgctggtgcctttgaaatgtcccgcgcccttcatgagcgtggagctgtctgtaccctcatagacccgcacactcaggccgatggcggggatttttaaggtacccaggtatccgccggagtagtagaggtccgaggccaccggggtatagcccaaggtgccgccagattccgtctcctgctccggttccgcggggacggcggtgaaggtgtccacagaaggcgggaacacaacgggcatcccgctgccgttgacggcgcccactgccataccctccggggccagattgggggtaagccaggttccggtgttcagagtgtctgcgctggcgctgccgaagcccggcgggatgagggcggcattcttgctgatgtcctcgtttttcagggccccgccgtctgccgtgtgtaccacctccaccgaggtgggcttgccgtagtccggcccctccggcgcgtcaatggcgtaatctaaagcacccgccggggtagccagggccgccgccaggcaggcggccaggcacagggtggccagcttcttcactccgaatcctccttgttctcccggcgccgcttgacgaacaggcaggctccaatcacgccgcccacagcaaagaccacgcccagcgggagcaggatggccgcccagttgaactgggccaggccatccccagactcctccatgggtacggcgggctccaggggctccccctcaaaaattgcaacgtaacgcacccggttcagggcgatgcggctgacggtgccggtgtagtccgccgtgacagtatagccggtgacataactgctggtggcggtgccggtgtaggtggccacggcggtgtaacagtcccccaggttgtaaccggccacgctggcggtgttgtccgtccgccagtcaatattctggagggtgaggttgcgcccgtcctcctcaatgctcttggggatgctggcggtatcctggctggccaggttgggataggagcgggtggcggacacctcccgggtggagctgccgtagcccgccgcttccacctggacagtgtccagctggagggacagggtgccggacagtccgtcctccgtgacgaactccttctcctggggcagcagggccaggacggattccatatccttgcttttactctccaacgataccgtctccgtgtgcggacggctctcatgctccggcagctcctgctggagcaggtctgtcagggtgtagtggaagccgtcctgctcgaagtccgaccgggggataccggcagggtcctgctccggggacaggtcatagaccttgcggatctccgtgccgtcctcactgcgggtgacagaggttggatagcagacctgcacctcggtgaccgcggggaatggctccgccgccagggcggttgggagcagcgccgcggctatcaacaggccggcggcgcatctcagaatggtgcgtttcacgatggggttcctccttcacattttgtcatattttgctccagccgctccagagtgcgccgggccaggaggcggaactcccagggctccagctccagggggcggtagtcgcctttgtccgtgatgccgtccgcccgcaccttgagcaccaggggcagcacggcagggtgctcctcgagcaccgtgggggccagccagcccttcccggccaggtacacccaccggagagcggaggccggattgccggggacgtcgggccagaggtatttccccaccagcttcttgcggcgctgcttcttgttgacggggatgggggccaggatcttgccctcaatttggtagcgaaggccaagatcctctacacaggcgcggaatgcctggcaggcctctggagtgtccgcccattgaggcagcggctcccccaactctgaggccagcacatcttccccctctggatcatctgggaagaggggcacgttcttcaccagctccagcacatggaagccgtccgtcaggcccagcaccttccgcttggtgatgggcatgccccggtagtgcgccagggcctcccccagctccgggcgctgccggatcgtccagcctttctgtaggaagccgccccggcccagccgcagatcatccatggtgtaataggccaagctcattcggcatcctcctcccgggtcagcagggcgcccaacccgaacaaatccacgccgcaatgctccagcatatccaggaactccgcgtcataggttcggaatacctcggacgctcttttgcacggcataccgctggctgaccggctgtccagagccaagcggacaaccatgccgatgttcagatcgtagagcagccggatggcatccagccgctcccttgcagtgcccccctgccgggtaagcacgatgcagccgtgctctgtatgcagggccagccgctccgcgtcctccagtccggagagctggagggcggcccgggggatggccagggtcttcttgcttgtgtcatggcagatggtaaatttcatcttctgttttcacctcgtattcttagtcctgcggccagtcccacacccgaggcagccgcccggtaggggcggacaggatccgcagctccggccggtcgctggacaccagtccggggttatccagcagggagagctggcggttgagcatggggcttgggtcaaagttggtcatgagcagctcgtggtacctggagtcctcctgccgagccatggggttggggcggtcaaagcccacaatataaaagtccggggcgaagaggtccagaatgtccggatggctgttataggacaggacgatgtggctgtcccgcgccgccggggcgcacaggcaatcgtggagccggacgtgatcccggagggcaaaggagggcgcgtacatcctctccgcctccagatagggcgggtccgcatagatcaccgcacccgtccggacgtactgccgaaccacatcgcagcagtccttgttctccaccaccacgccctggagtgcgtccgaggcgcgtcggagcaggccaaggaagcggcgcagctccacgctgcgcccgccgaagctgttcccggtggcgctgtagctgtaccggatgctcagataataggccgcagcccgctgtacgtccggcaggttggcccggcccatcaggagcttcttcacctcctgcctgtccatgggcgggaagtactcctccgcgatctggagctcctcctccaggaagtcgttggggtcatacccgtggttgaggaagcggagcaccacctcgaagtccgcccgggcgtggaggggcaggaagtccagctccctgagcagcgccaggggccggtcccgggcacagcggaacaggttgaccagatccacatccacgtcgttatacacccggagcggggcatacccggcgcccaagcccagggtcaccgcgccgctgccgccgcagacctccagcagacggggcgccctcctggggagcagctggaaaatataggggagcaggaacagcttcccgcctacccaggggaagaagggtttagcgatccgcctcacctcccccgggtagacggaaggcccccgtggccctctccaagctacggatggccttctccacgccgtcccgcattcgccggagatgcccgattgtggcaatcacctcccaggcgttggcggggtagaagtagccggtgcggtcgctgcagataggcgccccgtccacccgcaggttatggaccagcttccgcagctctgcctcatggatgcggaacctctttttcatctgtttgccactgatggcgttttcccggccggggcagtgcttcttcaggtactccagcagttgcttctctttggctttcatgacgtcctccttttccgggccgtcctcccgaaaaagggcacaaaaaacaggggccgctgtccccttcgggaaaacggcccctgtttcgttttgatatagatttgatctggggttacatctgctgcatctgttggggcgcctgggattgcgtctgctgcctagcaatgtatgcacatccgtcctctgtcaaggtatagcccttcttccgcagcaaatccagtccgtaccgttccagatcaatgcagcctgacagggcccgatccacacatcccaaccgcacgcgcagatccatccacgccatgtcttggagctgatccgcccgcaccacctggtagcggttcaggttctgcgccaaatccagggcagcgggcagggtggcgcagtgctcatactccagtatccagagataggcctggaggaaccccttctgcccctggttctgttcctggaggataaatcccaggttctgaccgtcatagatgagatcctccagccgtcccctatatgcatcctccaggccggtgatccccggcaggctgcaccgggcctccagcagggtgcactcccggatggtctgcacacccagagcgtccagggccagccggatctcccccggcctcacgtccatgatgtcgttgtagtccggcagcgccagccacaccccctccggcaccgcggaggaggccagcttcagccgcaggctccagctgtagtccggcccaggcaggttgaccccgtcgtagaagcccgtcaccccctttcgcggatataccacatagcagccccctgcgaaccggccggggtgctgtgcctcatactgcctgcccagcttgtccaggtcgatgtagtcccgcagcgccaggagcctggcgttggtctcctccaggtaatacaggcccagatcctcataactctggatgccgcccaacacctcatactcgtccaggctggccagcaggctgaccacctctgtactgtcctgggcgggatggcgctggatggccgcgtccaaggcgatcccctcccgcgcggtcaacacctccagccgctcccgcagccagtcctgctcctccggcctgccggggagctgtaaaagtcctgctttatccatgggcgtttcacctcatttccatctgtacgccgccccgggtgggctggggcggcagcggtttctgcaccggctggccatccgcccgggtcagcagaccgtagtctgtcagctcgcccccgtactgctggatcagcgcctcgccgtagccgtagaggttcaggtaccagcacagcaggtcggcattctcctcccccatggagcggcgcagctccccgcgggccacgtcctctggagaggcggctgcccaattcagattgtaggcgtccagccgttccgtcaacgccatggcatcctccaggctcgaaatggacgacacctccagcaccgccttgtacttgatcagggccagagagtcccgctccgccagcaccatcagccggatggccaggcagttcagggtatccagccgctccggcgtggcccacgctgccggaagctggggtacccggctgtggaaggcggtgacggcgcagttggggaggcccacggcctccatccgctcccgcacctccaccagctcctgtccggcggggagggtgagctccgcccgttcctccccgagccggagctccagccgaaagaagccagtcggggcctccggcgcgatgcggagttcctggccctctgtgggcttccagttcccatccggtaccacatacccctgcctggtgaagaccccgcccgccgactgacggatccggcggcccaggagctggaagtccagcagttcaaataccttgtccggcacatccttcacctcggggatggaaccgtttgccgcgtaaacccggcccaacgaggcgtcatccgtggcctcgggcgccacctggcagtgctttgcctgctcagacagggtaatgagggcgtctggttccatgggcctgccgtcctgcagcttgactagcccctcgaatgcggtgcgctgccggctgtccagactggtcagccgctccgccagggcattgagcgcggggaagccctcgccagattgcaggccagggaacaggacggggaattccccatagtcctccatctcccattccactctggtgtccggtgcgagccgcagccgttcccaggcatccaggacagcatacgggtctgctggaagctccagtgtcacataagtatccttgtccggattgcacagggatactgtaaaggccttatccacggctcataccccccatcgtcatgccctgggcctgcgtcagcccgaactgctctgcctccgtctggatgctccagccctccggctgccacatgtggacgtaaagctccccgccgtccacacggattgcctgctgctccaggccctcgccaacgccgtccgcggcctggccggtgagatagtccttcagcccggtcagctcctccggagagagctggccgacgacctggcactccgccacgccccacagcctgccgtctctggcctctgccgtaaacacggcggagcgcaccttgacgtccaggaactccttgtcgcaccagagcatgaggccccgctccgcctcctccggcacccggttccgtaccatgaagcccaggatcctgtcctcatagtccagaagcgttctgccgtcccattcttcacccgtctcatcccaatctccccactcattccgggcatagaagctggcggtgaggggcatgtacagcttgagctgggtggactcaggcgggtggacggagaacatctcctccccaagggtcaggacgcactcacctccgtcgctctgccggacgtggaaccggcccgagtcatcgatgtgctccagagtaccagcctcctccagcgtgtttctgggatcatccagctcccatgtttggatccggctgcccgcggggaactgattccgcaggaaatccagccactccttcgatacaccctgcatgatgatctgtctcccttcattttgcctcaagtgtcattcggatagaaaaggccggcttccaaagcggaagccggccttcaacggagtccctgtgcatgctctgtttcctctgatggttcatagttctttcccgtcctttcttctggtaagcacacaacataccacagtgtgcccgtaatatccagcattttttacatctgcggctgcatgggcgcctgactctgactccgctccagccacagcggataataggccacctctgtgatacccagatccgcattacaggtgatatgggcggccacggcggggcaggctgacgagatctggaacaacgcctcggtgagctctgagcccaggccgtccaggatacagcggggcccgccgggcttttcggcaaactccggttgatccatggtgaggcgggccatggcctgggtggcggatatgcctgtttcccggccgtatgtgatggcccgcttcaaggcatgctgcggattgaagcgcccaaagtccatggtgtaaaaccgctgttcctgcccggactccacaatggtgcaggtcgcaatccggctgggctcctccggccgctccgggccaaagaagcccataagccggccctccttggccaggccggacacctctgccggtgtgcgcccggcctgaaagtagacggcagcggcgaacagctcgctgggcagagcggcgttttggtgctggatgacctcataggcgccctggagggtttcctcaccgaaattccgcgccaccactcgcagggcggtgagcatatcgatgtactccgtctccgcacactcccggtcaaagcggtacagcgcctcggtggtgacggggtccggcctgggaaccagttcattgatctgccggataaactcttttttctgtatattctctccccctcggttcacatggatagcccgcccagggatggcccctggctggggtgatccttgtcggccagcagttgtaccagagttttcaaatcctccggtgcaatccgctcaaccgcctggcacagccggttgaggccattgatggacaggcgttccgccggaatgctgctgatgacctcgccgggcagggtgctgtctactatccaaaagtgggggctgtcccggatgccggtgcggcacaggagacgttccagcctttccgggctgtccggcagaaccagcagtgtgctctgcccctcgccgtaggatgcctccaggagtatgacgaactcccggtcaagatagtccggaaaggggccgccctccttgtagaacttctccagctccataccgttatcataaaccacgccatagggtgtgatagtgccatgcttgttgaggatcaacttcaaggccgctgctctgccatccacctgttccagctcctcctcactggcacagccgccctccagcgtcatgtaatgctggcggcctacagcgtccaaatccgaaaagtccgtgatcaccgtggcctgctggcagcagaaggtaagattgatgaagtccgtcatatcaaacgtacccagcctgaccgccatagcctggaactgggcggcctcatagtcgtcaaagctgtccagccgccgggccaggtagtccagctcgtccagattggcgcccaccttctccaggcgtttgaggatggggaagccgctctccagctcgtccacccggcagtcccgtttcaggggggctcccagctccatagcggccaggcattccagggtgcgctcatattccatgccggggatggggaaggggatggtcacctggccatactccgggtgcgccgcgttgctcaggacacagcgcagcaccggctgtctgttctgtgtggtcacatctgctgccctcctatctccggcccctggcggggcacgtaatcctccagcggcctggggttctcctccccatacaggtcataggtcatatcgtccgccgccttgcgcaccgccgggtcatccgtcagggtctcgaagcggaagccggtcacatcccttgtgggcagctcctcccggatggtccggaggtaatcctgtggggctgtgaactccatgcgctcgccattggcaaaggaaacccggcccaccggcctgtccagtcccagtgttctgtccgcctggtcatctgagtagaacaggccggcctcctcacgggcggccggccgcaggggaaagcgattgttacatggattcatctgtgtgaatctcctccttagtttcttgctctgcccacctgtccgtggcattgagccgccgcatctccgagcgcaggcacttcccatccttcccccagcagaggaagccgttggcagggtaggggcagcccacacagaggggggagcgggtgcatactggcctgggcggcggttccgccgggtgctccggggcataaatcttacgggcactgaaatggaataaaatctgggcatagaaaaaggcggcgcctgatttggcgccgccctcacatggacggttcaagatttactccctctttctatatcagatgttgcgctaccgccggcggttagcctcgccctgggacagggcggcctttccactccagtggaagtaaacgatccttctttggcgcaaaggtgaggggggctgtccaaggacagcccccctcctgtatgcttccgtctcagattttagatggcccgcactccgcgatccaactgtccaggttcaggctttccgccatgagaagggccagcttgtgcatcgccgcccggtcttgggcatcctccagcctggccgtcgtctcaaacaggccccagagcagttcggcaatcatcttgccgtcgtaaggcttcagcagttcgctgttgggcagagcgtcctcgctgctcccgctgcgcagaagctgccgttctctttcaatcagctccaggctggcctgcaggctctcccggggcacttcccaggctttggcaatcagcttcacgcctgcctccatgggagcctcatccccgatcttgtccggcccgcccagcgccagggcattgattgcctcctcagttatctgctgaagcagcttctccggcgcgggatgcttctcaatctgtttcatacgtgtgtcctcctcgttattttttggtgggcttctgaccacaacaatacccgcttttgcgggataaagctatcaccatacgtaacgaaaaaaatgccgcaaaccaagcgataccaacaatttctgtatagaaaaagcggcgcctgatttggcaccgccctcatatggactgtccaagcttctgactttcgctctgcatctgatcctgggttctttccggcagctgggctgtgatctgatccaggaggcgccggcattggaactcctgctggtaggaggcgggccctctccatagaggaagccctgcaccgcctggcgcagcccctccagctgctcccggtcaaagacccgttccctggccaccagcccggagcggagggcgaagtcctccctggcgccctgatagtcctccatgtagtagtggccgttgttgaccccgctccggtcatagtcccgggcccaggtgacgaactgggcccccagcagcgtctctgtcccggccagcactgtgccgttgaactctgccagcacccggtaaccgtccgccaggccatccgccttcagaggtggggcattctccagaagcgtcatgtactccatcaccgtccccgccgcctccgtggcctgagccagggcggcctttgccctgctggtgtctacccaggtggggtcataccggacggcgccgctctccgtgacccggcacaggatgcgtccgttccactccaccgggagcaggccgtcctcctccagcggccggggcagtagctcccgccgccgcagggcgtaggacagttcctcgaaataggttttggggggcatgttcgtattcctcctttgggggctcagcgccctttttcgatcaccgttctgcgcccctgcccgggaatttcaccataccatcttctctacaaaaatctattcagcaaagcagacgcaaaggtgtgcgccctttttgaacttcctgtgcagcaaaaaagcgccggtctgatggttgcgaaaccaacaaaccgacgctctactttttgtatatattttttcctccatttggcggccttcagggctgaaaaagggcgcaggggaggggtaaccggtatcttatggagcgatccggggttcaatgtccttctgtggctccacaagcctcgaaaatatctttttttcagaacacaaatttcagggaaataaaaaagccacaccctctgatactctaagcattccgcttaaaatatccagattggtgtggctttatggagctgctatccggatttgaaccggagacctcatccttaccaaggatgtgctctacctactgagctacagcagcaaatggcgacgcggaagggacttgaaccctcgacctccggcgtgacaggccggcgttctaaccaactgaactaccgcgccatctttctatcaaaagacagcggtcgctgtaatttgtcatggcaggggcagaaggattcgaaccctcggcactcggttttggagaccgatgctctaccagctgagctatacccctaaatggtgggccttcacgggctcgaaccgtggaccggccggttatgagccggctgctctaaccaactgagctaaaggcccataccgttccacagcgtttaaaaagtaggcttgccgtcacagcaactgtggcggcaagccacattctggctccccctgttggactcgaaccaacgaccctgcggttaacagccgcatgctctaccgactgagctaaggaggaatatgaaaggatccggcctggtcaggccagacccttcttttgtgtcggcgttacctatcttcccggtccgtctccagacaagtattttcggcgcaggtgagcttaacttccgtgttcgggatgggaacgggtggaccctcaccgcaatcaacaccaacttactttccttcgaaaagaaaagtaagcaaaagaaactctaacaactttcttctccttaccgttcttctcaacgataagtcattatattcattttcttcctctttgtcaagggaaaaatgatggtgacccgtgcgggaatcgaacccacgtttgcggcgtgagaggccgccgtcttagccgcttgaccaacgggccattggtgcgccttcacggattcgaaccggggacccactgattaagagtcagttgctctaccagctgagctaaaggcgcttgtcgccaccatccagggtgctgcaccctcaaaaccgaacaatgtaaatcttccgcacttcgcaagcgcctgcaatcatccatgttaaggtcaagccctcggcttattagtaccggtcagctgcacacgttaccgtgcttccacctccggcctatcaacgacatagtctacgtcgtgccttacttctttcgaatgagagatctaatcttagggggagtttcacgcttagatgccttcagcgtttatctcgtccgtacatagctacccagctatgcccttggcaggacaactggtgcaccagaggtacgtccatcccggtcctctcgtactaaggacagctcccttcaaatctcttacgcccgcaacagatagggaccgaactgtctcacgacgttctgaacccagctcgcgtgccactttaatcggcgaacagccgaacccttgggaccgaatacagccccaggatgtgacgagccgacatcgaggtgccaaacctccccgtcgctgtggacgcttgggggagatcagcctgttatccccagggtagcttttatccgttgagcgacggcacttccacttgcataccgccggatcactaactccaactttcgttactgctcgacccgtcggtctcgcagttaggctcgtttatgcgtttacactcactgcacggtttccgtccgtgctgaacgaacctttgagcgcctccgttaccttttaggaggcgaccgccccagtcaaactgcccacctaacagtgtcccccgaccggattcacggccgcaggttagaaaaccagcaaatcaagggtggtatcccaagggtgactccaccaaagctgacgccctggcttccaagtctcccacctatcctgtacatgatttaccgatttccagtattaagctacagtaaagctccatggggtctttccgtctagttgcgggtaactggcttcttcaccagtacaacaatttcgccgggtgggctgttgagacagcgcccaagtcgttacgccattcgtgcgggtcagaacttacctgacaaggaatttcgctaccttaggaccgttatagttacggccgccgtttactggggcttcgattcaatgcttcgccttgcggctaacatctcctcttaaccttccagcaccgggcaggcgtcagcccctatacgtcatctttcgatttagcagagacctgtgtttttggtaaacagtcgcttgggcctattcgctgcggcctcccgtaggaggctccccttatcccgaagttacggggtcattttgccgagttccttaacaacccttctcccgttggccttaggattctctcctcatctacctgtgtcggtttgcggtacgggcaccttagcataccatacaccttttctcgccacagagcatcgcggacttccctactaaagttcggtcccttacgcccgggtcaaccaacgcccgggtcccgctatctccatgtgtcagtgtacttaaggttcggtggctacggaatttcaaccgtatgtgcatcgactacgccttccggcctcgccttagctcccggcttaccctgggcggacgaaccttccccaggaaaccttagattttcggccattatgattcccacataattctcgctactcattccggcattctcactcgaatacagtccaccgctgcttccgctgcgacttcaccccatattcgacgctcccctaccccgcacattgctgtgcagcccaagcttcggtgttacgcttagccccgttatattttccgcgcagagtcactcgaccagtgagctattacgcactcttttaatgagtggctgcttctaagccaacatcctggttgttttcgcaactccacatcgttttccacttagcgtatctttgggaccttagctgtgggtctgggctgtttcccttttgtccacgagacttatctcacgtagactgactgctggccatcaattatccggcattcagagtttgatagggttcagtaaccttatcggcccctagcccattcagtgctttacctccggtaatctaagccaacgctagccctaaagctatttcggggagaaccagctatctccgagttcgattggaatttcaccgctatccacaggtcatcgccgaccattgcaacgggcgtgcgttcggtcctccatggggttttacccccacttcaacctgcccatggataggtcacccggtttcgggtctattgccactgacttcatacgccctattcagactcggtctccctgcgcctccggcactgaatgccttaagcttgccagtaacaataactcgccggaccattctacaaaaggtacctcatcaccctttaacgggctttgagtgcttgtaagcacaaggtttcaggttctctttcactcccctcccggggtccttttcacctttccctcacggtactgctcctctatcggtcatcaggtagtatttagggttggagggtggtccccccagcttcccaccgggtttcacgtgtccggcggtactctggatccagtcgcacaaccttccctttcggatacggggctatcacccgctatggccggccttcccataccgttctcctagttccagttgctaaaaaactgtccacaaccccggaggataaatcctccggtttgccctcttccgcgttcgctcgccactactagcggaatctcggttgatttctcttcctcgccctacttagatgtttcagttcaggcggttccccgcgtacgcctatttgattcaacgcacgctgacagagtattgctctgccgggtttccccattcggaaatctgcgggtcaaagcttatgtgcagctcaccgcagcttatcgcagcttgtcacgtccttcgtcggctcctgatgccaaggcattccccttgcgctctttctagcttgaccttgtagaacagtctcatctctgagctgttctcaaaatcatgaattatgcaggcatcacagaagttttgcaattagctccattgtttttacccttactagaacggctttcgccattctatcttagttccacaacattgctgttttgccctctgttgcttgctcttgtactttcgatttacattgttcagttttcaaggtgccgccttccagcctttaaggccagattttaacactcaatcccttgagtgttaaaatccattcttaaattggtggaggttaccggactcgaaccggtgaccccctgcttgcaaagcaggtgttctaccagctgaactaaacccccagggttttggtggtgggcccaagtggactcgaaccaccgacctcacgattatcagtcgtgcgctctagccagctgagctatgggcccgtcgtcgtcgacgcaaagtccgctccgttcgtgacgccctcacggccatccctcactgcgctcccttgcgtctcctctcccgaacagacccgcttcgctgggctctgttcgggtacccgagagtgtaccctctaaattaaacaacgtgaaagccattcgctccagaaagctgaccttaggacgttacaacagaaaactacttccgttgaagtctccttagaaaggaggtgatccagccgcaccttccgatacggctaccttgttacgacttcaccccaattatcgaacccaccttcggccgcgccctccttgcggttaggctacggacttcgggtgttcccgactctcatggtgtgacgggcggtgtgtacaaggcccgggaacgtattcaccgcggcatgctgatccgcgattactagcgattccaacttcatacaggcgggtttcagcctgcaatccgaactgggatggcttttagggatttgctccacctcgcggtattgcctccctctgttaaccaccattgtagtacgtgtgtggcccaggacataaggggcatgatgatttgacgtcgtccccaccttcctccgttttgtcaacggcagtctcgctagagtgctcttgcgtagcaactaacaataagggttgcgctcgttgcgggacttaacccaacatctcacgacacgagctgacgacaaccatgcaccacctgtctccactttccccgaagggcacctaatgcatctctgcttcgttagtgggatgtcaagccctggtaaggttcttcgcgttgcttcgaattaaaccacatactccaccgcttgtgcgggcccccgtcaattcctttgagtttcaaccttgcgatcgtactccccaggtgggatacttattgtgttaactgcggcacggagggggtcagaccccccacacctagtatccatcgtttacggcgtggactaccagggtatctaatcctgtttgctccccacgctttcgcgcctcagcgtcagttactgtccagcaatccgccttcgccactggtgttcctccgtatatctacgcatttcaccgctacacacggaattccgattgcctctccagcactcaagaactacagtttcaaatgcaggctggaggttgagcccccagttttcacatctgacttgcaatcccgcctacacgccctttacacccagtaaatccggataacgcttgccacctacgtattaccgcggctgctggcacgtagttagccgtggcttattcgtcgggtaccgtcatttgtttcgtccccgacaaaagaagtttacaacccgaaagccttcttccttcacgcggcgttgctgggtcaggcttgcgcccattgcccaatattccccactgctgcctcccgtaggagtctgggccgtgtctcagtcccaatgtggccggtcaacctctcagtccggctactgatcgtcgcctaggtgggccgttaccccgcctactagctaatcagacgcgaggccatctcagagcgataaatctttggcagtcagagccatgcgacccaactgcatcatgcggtattagcactcctttcggagtgttattcccctctccaaggcaggttcctcacgcgttactcacccgtccgccactaggtaactcaatccgttggacgaatcctccgtcatgagcaccccgttcgacttgcatgtgttaagcacgccgccagcgttcatcctgagccaggatcaaactctcaataaaatggtatctaaagaacgtctccgttcctcaaatcatcttatcgaagcttaattcatagcttcaaagaaatctattcaagagccttcttcatcaagcttgcgcttgctcagaaggacttctcgtcctttctggtgcttcgtgtttctctcacgttgtttaatttacaaggtacacgcccctgtcagcttttccactgacgtgctatttattttagcactcacgctttcgcttgtcaagaacttttttcaaacttttctgaggtttttcagcctcacagccgttctttttgttcttttcaagcaggttcccgcctctcggcgcgaactcatttagtttaccacgccctcactcatttgtcaagcacttttttcagcccgcttccgaaagtccgtccggcttccgcccggtctcttccgtccgctttcctgttttttcatgccctccgtgaggcgctcagttagaataccagctttcctcctctttgtcaacacctttttctctttttttcaggtttttttctcggctgtcaaaccggaccggatcactggtattctaatccatagcatgcacaagatctgccacccttatacctgcctgcgcagcttttttaccagcaggagcaaaacaggaatgacgaagccgaagagcaggctgccaatcctggccgggccctccatccaccgctccagggaaaaggcgtcgggaaagaggaaccaggcccccgccagggccagcaggagcagaggaagtacggcgtgcttgcgctcctttaaagagaatacggactgggccaggacggagcaggagcccgccagcaggttgagcagggctagatcagagaacacccagagggcgatgatgaccgactccacccgttggaaggtgccctcgatgccgatcccctttaccatcataaaaaagggtgtgtccatgcgggcggtcagcccgggcccgaagttgcccaggcagacaagctgaagggcggtaagcaccagacagaaggcggccgcccaccatagcgcacggcggcggtctccctctccccgggtgacattcccccccaggaaggcggcaaagaccacataaccgaacaggcccagcaccggaacggcggcggagagcacccccggaagatcctccgtccacaggggaaggatgtgccggggctccacctggagtacgcccaggatgagggagaagcccaggccgatggccagggccaggtagaacacctctccggtccgtgccagcacccgcaccggcttgcgcaccagccagagggtgagccccagcagggtcagcaaaaacagacccaggggggcgttccggtaactggtggacaggaaacggagggcgaaaagcctggcgttggcgctgagcagaagcagaccccacaataaatagagaagaagtacccccttgcccaaccccctgcccaggacggtctcggtgacctgggccagccccgccccctcccctgccgggcgcaggagggcaaagagtacccagcacagccccagcagtaccggcagggcagccagggcggacagccaccccgcctctccggccagggcggcggtctgggagggcagcacgccgatggccggagccaggagggcagcgaagaggagcgccaggagctggcgcagggagattcggtcgtcaggcatgggtataccgcctttcctttgagctgccgccctcaccgggcggcgtcatagctgcgctgaagcttggccgtcacgtgcagctccagctccagcgcgcccagagaggccccttccagcgcctccttgtgccagggccgggccagggccgcccgccggagcagccccaaatagtccgcgtccagctcctgtgccagttccagcgcggaccggatgcgcgcctcctccacctgggccagggccgcctcgagggaggcgtgtacctcctccgttcggaggtccaaattcccctccgccatattggcgtccagcgtacaggtgagggacaggccggtaagggcgcccccgtccatcaccgggcggacggaggtcctggcccccaccacacgcagggccgccactccgcctccatccaggggcaactccaccacatcggcgtccacctggcccagtaccaggttgacccccagggcggcgtccccctcagcccagccggccaggctgtccccttttaatatgccatacccggcggcggtgagagcctcgtccgcctctaccgccgggagaaaggtggccccctgggcatagagatccgagagggcgtcctttacggtgcggggcatggaaccggccagcagacccgcgtcctccgccagcgcctccagccggtcagcggcggagccgtcctcccccgctgctgtgatcgccttgcctgctgtgccgccccgcaccagatagagggcggtgtccagccgggtctccacatcccggagaatatagtccagggcgggctccaccccctgcctggccagctcctctcccagcaggagctggcccacgtggccgaagtagaggtaggaggagccctccccctgcatccccagcacggcggcgctgatggtgccggcctggccggacacaacggtggccgccccctccgccggatcgcccgagccgctggaggcggttacctccacctgcccctccccggcccggtccacgcccagggtctgcatcagctccatgtcctcgatttcccgggcatagggcagcaggccgggcccacggcggcagccggtgagggtcagggcggccaggccggccagcagcagggctgttatgcgtctcatttctgattcctccggtttcgggttttcagggccgccgggcgctgctttacctggggcaggggctggcggaacaccgcgtgcccctccacctgctccccggcattcgaggcaaagggggtcaggtaggacacgccgaagctttcaatgcccgccagatggatcaccagcgccgacaggccggccaccacgccgaacaggcccgccgcgctggccagcagggccagcaggaaccgccagatgcgcagggcgcccgccacctcctgagagggcatggtgtatccggcgatccccgcgatggccaccacgatgagcaccgcgggggagatgatcttggcctccaccgccgcgctgcccaccaccaggccgccgatgatagacacggtctgcccgatggactggggcaggcgtagccccgcctcctggagaatctcaaaggccagcagcaggacgatgacctcaaagacggagcggaagggcacgtcctgcttggcggcaatgatggacagggccaggcgggtgggaatcatctcctggtggaaggtgaccatggccacatagagggcgggcagaagcagggtgcccagcatgcacaggtagcgcagcagggtgagggcggaggccagcagccagctctcgctcttgtcctggggcgcctggaggaaatcccccagcacgccgggggccaggtagcccaggggcaggccgtcgatgaggatgcccacccgcccctcggccagcccggcgcagaagcggtcggaccgctcggtatattgcaccagcgggaaggcggtgcgggcggcggggacgatatactcctcaatattgcccgtggccagcaccgcgtcgatgtcaatgtccgccagttgggcggccacctgctccaccaggtggggattggtgagcccctctatatagaggatgtccaccgacgtgaccgactggcggcccaccacctgctcacggatacgcagctcaggggtcttcaggtggcggcggacgatgctggtattggtgcgcaggctctccacaaaggcgtcccgggagcccttgagcaccgtctcgttgctgggagagctgatggagcgcttttcctcggtgcccacaaagagggacagcaccgcagattccccgggaaagaacatcaggcaccatcccgccaccaggtcaaaggcggcctcgtccagtgtggtacgctcggccgcagagagattatacagcgctccccccatcatctcctccatggcctgccggggagtcccgcagcgggccagcgcctcgtcctgggccagcggccggagcacgtagtcgctgacccgctccatcttcaccatgccgctgaggtagcacagggtgagcgtacacgcgccgccctcccccagggacaccggacgcttggtgaagtccacgcagtcctggaagatctgctccagccgtttcaaggtcagcggcccgtcaaagcggggctccttccggggatggggtacgctgggggcacgcttccgaccaaaaaagcccatggcgcacacctcctgttgtctattttgctgaatcgaacttttttaggatggcccgttttcgcccggttatacaaatttaaacgaaccagttgcaattttccagggatgttgatatactttataaaaactataaagtttaatagatgaactatctactttccttttggtaattatcccatgtcctccgcaggacagggttcattttatgtgataaggaggagccccttatgaagccctttacccagactgccgacaccctggaccaggagctggcggacaaaatcgacggcattctcgccgcccatggcgaagatcccacccagctggtgggcatcctgctggacgtggaggccgcggtggagcggcactacatcccggaggccgccgcctactatgtggcggagcgcctgggggtgaagcccacccaggtctacgatgtcatctccttctataccgcccttcacgacaagcccagagccaagtttaccctggaggtgtgctcctccgccccctgccgggtgaaggacagcgacaccctgctggagcggctcaagcgccttttaaatctggaggtgggccaggtgacctatgacggccgcttttccatcgagcaggtcccctgcttcggggcctgcgacgtgtcccccgccgtgcgggtcaacggcgtggtatacggccatctggacagcgaggagcgtatcctggatatgctccagcagctcaactaagggggaacggacatgagcaagacggtttgtttcatcacccggaatttcgggaagtacgacccggacagcctgaagggctatgaatccatcggcggcttccgggcgctgcgcaaggccctgaccatggagggctgcgacattgccgacgtgctggccgccaatggcgtccagggccggggcggcgcggcctacgacatgggtaaaaagtggcggcaggcccgggaggtacccggcgcccacaagtgcgtagtgtgcaacgctgacgagggcgagccgggcaccttcaaggaccgggagctgctcacccacgaccccttccaactgctggagggcatgatcatcgccggctgggccgtgggggcggacaacggatacatctacctgcgggaggagtactcccacctgcggccccggctgctctccgccatcgcccagtgcgaagcggcgggctacctgggggaggacatcctgggctccgggctgaactaccgcatccacctctactccggcgcgggggcctatgtctgcggcgagggctccgccctggccgagtccatcggcggccacgccggccggccccggatgaagcccccgtttatcaagcagtgcggcgtgttccacctgcccacctgcgtcaacaacgtggagtccctctccctggtggcccccctgctgctggacgacgagggctactataagagccagggcacgccggactgcccgggcaccaagatgatctcggtgtgcggcaacgtcaagcgccccggcgtgttcgaggtgcccttcggcatcaccatccgggagatcgtctatgatctggccggcggcatggagaacgaggactaccccctgcgcttggtgcagcttggcggcgcgtcgggccgcatctgctcccccgcccaactggacaccccctacacctacaagggcatgcgtcaggcggatctcaccgccatcggctccggcgcggtgctggtggtggatgaacgcaccagcgtcatcggctttctgcgcatgacccaggagttcttctcccacgagagctgcggccagtgtaccccctgccgggagggcaaccgccacatctccctgctgctggacaaggtggccgagggtacccacaccgcccaggacatcgccaccctcaagaaatttgccgacattatgtccagcgcgtccctgtgcggcctgggtgagacggcccagtccgccctgctgagctgtatgaagcgcttcccggaagtctttgccgtaaaagaggaggtcgccgtccgatgagcgagatggtacatatcacaatcaacaagcagccgctggaggtgcctgcgggcacccgcatcattgaggcggccaagatgctcaacatcgatattccccacctgtgctaccacccggaccagaccatcaaggcccactgccggatgtgcatggtggaggtggtgggctcccgcaagctgacggcggcctgctccaccgtggtgtgggagggcatggaggtcatcaccgactccaagaaggtgtacgatgcccagaccggcgtgctggacctcatcctctccgatcacaagaccaactgcctttcctgcgcccgcaacggctcctgcgagctccaggcgctctgccgccgctttaaccggctccacccggagctgcccgacatctcctccgacgagccgctgcgcatcgacaacccctccatcgtccgcgaccccgccaagtgcgtcaagtgtggccgctgcgtgaaggtgtgcgccgaggtccagggctgcgccgccctgacctactccggccgctccgccggcttcaaggtcaccaccgcctttgacctgcccatggaccagaccgactgcgtgctgtgcggccagtgctccctggtgtgccccgtgggggccatcgtggagaccgactacaccaacgaggttaccgccgccatccaggactcctccaagcacgtcattgtccaggtggccccctccgtccgggtgggcctgggggacgagttcggcatggaggccggcgccgtcgtcaccggcaagatggtcactgccctgcggatgcttggctttgacaaggtgttcgacaccaacttttccgccgatctcaccatcatggaggagggcagcgagctgctcaagcgcatccgggagggcgggaagctgcccatgatcacctcctgctcccccggctgggtcacctacctggagaagcaccaccccgagctcatcgaccacctctccaccgccaagagcccccaggccatgttcggcgcggtggccaagacctactatgcccagaagatgggctgggatccccacgacgtggtaagcgtgtccgtcatgccctgcaccgccaagaagtacgaggccagccgccccgagctgggccgggacggctatcaggacgtggactacgtcctgaccacccgggagctggccaagctcatacgctatgtgggcctggacctgtccgtgctgcccgagagtgagtttgactcccccctgggcaccggctccggcgccggcgccatcttcggcgctaccggcggcgttatggaggccgccctgcgcaccgcctacgagctctacaccggcaagaccctgccccggctggagtttgacgccgtacggggcgacatcaacgccatcaaggaggccaccattgacctcgacggcacccccctgaaggtggccgtggccaacggtctgaagaacgccgaggagcttatccgccgggtagagcgcggcgaggccgactatatcttcatcgagatcatggcctgccccggcggctgtatcggcggcggcggacagcccatcggcaccaacaacgccgtccgggacgcccgtatccaggccttgtatgagatcgaccggagcctgcccctgcgcaaaagccatgagaacccggagatcaagaccatctacgaggagttcttcggcgcgcccctgtcccagcgctcccacgagctgctccacacccactaccatgcccgcaaaaagcggcacgatttttcccacctgaattaagcgcagaagggccgtggggccgccggatccggcggccccacggccgttttatgagcttattccgggataaattccgtggtgcagtccatgccgttccatacctccccgtcggagcggtagtacttccgctctgatgttccgtccttccgggtgtagcccaggacaaacacctgcccggcctcaatcggcatgggatagtcgttgcagggcagcacatcgctgctctcgggacagtcctcgaagtcctcataggccccctccagccgccagaaggcccgggactggtagtccccggcccagccggagatatcctcctccccgaagtaggacgcctggtactccttccccgccacggtgagggtatccgtccgctggggctcccaggcaatccaggagatgtcctcggtgtgaagggagtccccgtaccgctctaccagctgagcggccatggaggggacggttcccgcggagtccgccatggcatccgggtcggtgtgggccgcgccatagatgcccatgacgctctccccatccagggcgtcaaactcccggatgaagttctctgccatccggttttcccggtaaatatcggagccacgctcggcaaaggttttcccctgctggatggcctccagggtcaggcggtagtcctccgtgtccgccaggccccgctcctccagatagtcttggtaacgggccccggtgctgtcgtactggtggcccacgtcggtgccgtggaacaccgtctcggggcactgctccttgatggtgcggtaaaaatccagcgtctcggcgccggatgagagcgtgctctcccaatcctggtggagctgctccagaatctcatcgtcctccgcgtccatccacaggttgagccactgggccgtgtagtgcgagagctccacaaacaggtgccgcatcccccgttcgtagcactccttccaccgctccgcctcgtactcctcgatggcggcgattccgtggatctccccgtagaggtagatctgccccgctggaatgccctcatccgtcgccaccggggactcttgtaccggcttcccggcgcagcccgccagcatcaggagcgccagtacgaccgcaaattctttaacatacctcatattcggcacctcccaaggcctttttcccagtgtagcagatcccaccctgtcaaaaaagggttctcagattaaaatttgctgtaatccacccacccggcgggcccggcccaacttttacaaaaaagagcttgacaaaccgggccgccgccgttatactgtagcaaatcaaatcggtaaaccgatgacgaagaggagtagtccggtatcaatgcctctcagagagccgcgggtggtggaatcgcggcaggcagcgctcggatgaatggacttttgagggcacagcgaacagcctttgggctcagtagcgcgacggggactccacccgttatccggggagcatgggctgatcggcccgtgaaagtgagtgggcgtatgcgctggtatacgtcaatccgggtggcaccgcagaggctgaagctacagtcctttgtcccagagaaacaatcttggggacgaagggcttttttgtacccttttcccctgcagcacagaaaaggagtgtatcaacatgagcaagatcccccaccgcctgtatctgaccgaggaccagatgccccagaagtggttcaacctgcgctccgccatggccgagcagcccgatcctctgctccaccccggtaccctccggcccttgggtgtggacgacctctcccccatcttctgcgaggagcttgcccgccaggagctggatggcgccaccgcctatgtggatattccggaacccattcaaaacgtctataagatgtaccgcccttccccgctgattcgggcttacgagctggagaaggccctggataccccggccaggatctactacaagtttgaggggaacaacacctccggttcccataagctcaactccgccgtggcccaggcctattatgccaagatgcagggcctaaccggcgtcaccactgagaccggcgccggccagtggggcaccgccctcagtgaggcgtgcagttacttcggcctgacctgcgacgtgtttatggtcaagtgctcctacgagcagaagcccttccgaaaggcggtgatgaatgtattcgacgcctctatcaccccctctccctcccccacgactgaggtgggccgccagatcctgcgcgaccacccggagactacaggaagcctgggctgcgccatctccgaggcggtggagtccgccgtccagagcggcggcgccaagcgctatgtgctgggcagcgtgctcaaccaggtgctcctccaccagtccatcatcggcctggagagcaagctggccatggagcagctgggggaatatcccgacgtggtggtgggctgcgccggcggcggctccaacctgggcgggctgatcgccccctttatggccgacaagctgcgggggatacggaatccccgcatcgtggcggtggaaccagcctcctgcccctccctcacccggggcaagtacgcctacgatttctgcgacaccggccgggtcactcccctagcccggatgtatacccttggctgcggcttcatcccctccgccaaccacgccggcggcctgcgctaccacggcatgagccccatcctctccaagctctaccacgacggctatatggaggcggtggcctatgagcagacccgcgtttttgaggcggcggtgctctttgccaagcgggaaaccattctccccgcccctgaatccgcccacgctatccggggggccatcgacgaggctctgcggtgcagggagagccgcgaggccaagaccatccttttcggcctcaccggtaccgggtactttgatatgaccgcctatgagaactacctcaacggaaagatgagcgattccatccccaccgatgccgacctgcagaagggtttcgacagcctgccaaaaatcccccagaacgagggtatttgaggcttcacagcaaaactttaggttgcacattgtcccccggctggctataataggagggacaataaacacaaaagaaggttttgccatggaattccgcgcaaacgagggaaagagcgtcaccatagaggtgggcggaaagacctacgcccgccacgccatccagacccatttcgtccaggtgggcgagagctatatcgacctggtggagcagtacgtcaagcccgtgtggcagcccggcgacctgctctcctccagcgagaagatcatcggcctgtgccagaagcgggtggtctacaagaaggacatgaaggtgggccgcctggcccggttcctgtcccgcttcgcctcccactcctccgccggcatcggcgtggacagcccctacaagatgcagttcgccatcaacgagcggggcgccctgttcgtgctctgggccgcgttctgcgccggcgtggccaagctgttcggcaaacggggcgtgttctacgagatggtgggccaggaggtgtccggcctggacggcttctacgaccacgagttccaggagtacggcgagttcggcatccgcatcccggagaaccccggcaaggtgtgcgacgagatcgaggccgccaccggcgtgcaggccatgattgtggacgccaacgatctgaacgtggagattctgggcaaggcgtcctccgtcaccctggacgacgagaccctcaagggcctgatccgggacaacccggcgggccagtcccgggagctgacccccttcatcctcatccgcgaggtaaaggaggagcgcgcgcctgaggaggcgcaggcataaatccgtttacagacagcacaagaggcggaattccccccggcctgcggccggtgggaattccgcctcttaattcgtcccggctcagcgccgggcacaggctggctccaccttctccgcccgcgccggacggcgggtccggccgcggctcacggccttggccagctcgcacaccaccacgggggtaatggccagggccagcaccacggcccactccagagggctcatgggaacggtgctgaacaccacctgaaggggcggcacgcacaggacggccaactgcatggtaaggccgatgagaaacgccttgttcatggccggattggagaacaccccgatgtgaaagagggacgagcgctcgctgcgcacgtcaaaggcgtggaagagctggcacagggtgagggtggcgaaggccatggtgttggcggcggcgtgggcctcgccggggtcggagagcacatactcccccaggaaataggccgccagggtcagcagccccaccatcaccccctgccaggccagccggaaggcaaagccgtgggcaaagagggaggcgtgggcgtcccggggcggctgggacatgaccccctcctccaccggctccaccccaagggccagggcgggcagggagtcggtgaccaggttgagccacagaagctgcaccggcaccagaggcatctggtggaagtggaacaccgtggcgcagaagatggtgaggatttctccgatgttgcaggagagcaggtagtggatggccttcttgatgttggcgtagatgccccggccctgctccacggcggagacgatggtggcaaagttgtcgtcggtgaggatcatatcggcggctcccttggccacgtcggttccagtaacccccatggcgcagccgatgtccgccaccttgagggcgggggcgtcgttgacgccgtcgccggtcatggccaccacctttccccgggcctgccacgccttgacgatacgcatcttgtgctcgggggacacccgggcatagacggagaacttctccacctcctgttccagcacctcctggggcagaaagtccagatcctcccccgtcagggccaggtccccggggcggtagatgtttagctcccgggcgatggccacggcggtgagcttgtggtcgccggtgatcatgaccggcttgatgcccgcggcgtagcactgctccaccgctgtgcgcacctccggcctgggcgggtcgatcatgccgatgagtcccacgaaggtgagtccctgctccagagcggcgctgttcagctcccggggcagcatggccagatccttgtaggccacccccagcacccgcagggccttccccgccatggcctcgttccggctctccagccgccgggcggcggcggaatccagcctgcaccggcgggcgagcacgtcgggggcccccttgacgcacacccgccagccgccgccgggcctctggtggacggtggtcatgagcttgcgctccgagtcaaagggcagctccccccgccggggccactccccctccagtccatttttatccaggccctcccgggccgccgcgtccaccagtgcggtctcggtgggatcgccggtggacaccggctcccgccccttccaggccagggcggcatcggagcacagggctccgatggtgagggccagggcccgctcgccgctccggggcgtccacacgtccaccacggtcatgcggttctgggtgagcgtgcctgtcttgtccgagcagatcaccccggcgcaccccagggtctccacggcgggcaggcgcttgacgatggcccgccgccgggccatgcgggccacccccagggccagcacaatggtgacgatggcgggcagcccctcggggatggcggccaccgccagggagacggcggtgagaaacatgtccagcatgggccgcccctggagcagccccaccccaaacatcaccgcgcacacgcacaggcagacgaaggacagggtcttggagatctccgccatcttcttctggaggggggtctgtccctctccctcccccagcagcagcccggcaatgcggcccacctcggtgtccatgccggtgccggtgaccacgcacaccgcccgcccccgggtgatgacggtggacgcgagcaccatattgtgccgctccgccaggggggtgtcctccggcagggcggacagcagccccttggacacggggacggactcgccggtcatggcgctctcatcggcctggagggaggcggcctccagaatccgggcgtcggcgggcaccaggtcccccgcctccagatggatgatgtcgccgggcaccagccggtcggtctccagccgctgaagcgccccgtcccgcaccaccttggccaggggggccgacatcttccgcagggcctccagggccttctcggcgctgtcctcctgggagatggagatacaggcgttcaccaccacgatgaccaggatgatggccgcatccagccagtcctcgccgccgctggcccacagggacagggccgccgcggccagcagcaccaggatcatggggtccttcatctgccccaggaagcgcagcagcagcccctgccgcctcccctcctccagccggttgggcccccagcgggccagccgccgctccgcctccgccccgctcagcccccgggacttgtccgtttccagctcagacagggtctgtctggtgctgtatgtatgccatacgcccatgtcgctcgctcctcgctcactgtagtttccaatttctggctacagtatagcagagtgcctgtccgatttcaggggaaacgtggcgctaccactccaaaatccgccgggccagccggcggagaaagagctcgttgctgggccgttcggccggaaggccgcccatgagggcctgatactccccgcaggccccggcctggagcttgcccaccatggagcggatgtttttctccacgcaggcgtagctggtgttttgggccgccatggcggcggcatacccctccttgagcggaatggccccctccgcgcccgtggagagcacggccgccgtccgcgcggcggcctccacccccagcccggacgcgcccatcccccgcagatagtccgccgccgcccgctcccggggctccaggcagagcgagtgaaacagatcgggcagggagtcgaagttgaggggctttatgagatagtagctggccccaagctgaaaggccagccggatgaccgtgggctccgaggcctgggaggccaccaccacagccgggcgctcattgcggcggcgcagggtgcggaggaaatcaagcccgtccatcccgggcagaatcagatccagcagcacgatatcgggcctggtctgctccaccagctccagcccctccaggccgtcctttgccagcgcgcacagacagacccccttccgtccggacagaagggcctccgtcagcatccgggtctccggatcatcctccaccaccaggacccggatctccagcgccacgcctactcctccgggcccagctcctgggcggcccggaacgccagatgcagcatgtgaacggccatatcccgctgcaccggagagagctggcgcaggtggcagagcaggtgctccagcacgggctcctccttctgcgcgccgtgggcgagctcatccagccctgtgtggaacacctcgcccagctccacaaaaatcgccatggacatacactttttcccctgttcaatatcatttacatattgggaggagatgcccaggcgctcggccagctcctccttgctcatccgcgccagcttccggctgtggtacacccgctcgcccacggccttttgcagcgccagctttttctccttgtcctccattgtgtctcaccctttgtcccaaactttagatatagattgacacaactttggatttttactataaacaatagaatctttcttttaaactatagttttttaatcaaaaaccccgccggatcggcggggtttttgcctgtgctcattgcgctccgctcccggtggcacccggtgcgggctctgtgctctgtgccggggtcccggtctcgggcgcgggactggcggtcgcctgagcggcctcctcggcggccttctcctcctgccactgctcggcaaaggccaccatattcttgtagaaggaattgggatccagcttctcataggcgggcttgacctctaccttcgcctcctccacccactgctcgttcagcttgctcatggcgtaatcggggtagatggccgccatgctgtcccggagctgctggcgctcctcgtcggtaaagtcctggcgcagaatgatgtggtagccgtaggcggtttccacgggctcgctgatctcacccacggccagggccttggcggtactctcaaactgaggcaccatctggccggcataggccaggtagccgtcgggcgcatagagctggttgttctcgtcccggccgtcgtcgctgcgttcgttcatcaccttgtcaaactccaccaaggggtctgcggcggtccgaatctgggccaggagctggtcggcctccgccttgacggcggccttctgctcgtcggtgacggcgctgccgtcctcgttctccgggaaggccagcaggatgtgtttggccttatagtaccccgcctcctccaccatggcatccagatcggcgtcctgggcggtcagctcccccgcctcctccatctgggtctggaggctccgggccagatagggcacctggttcagcttgcggaaagccgcctcgctgatgcactgctggtccaggtactcctgaagggtcatcccgtaatagctgtccacccgctgggtcagcgtctccagctcagcgtccgcctcggcctgctcctcctcagttacggtcagtcccgccgccgccgcgtggttggacaccgtggtgtagagcacgctggtgttccgcgcgtcctccttcagatactccgccgtggggacgccgttgagctcctcctcccaagcgtcgtcgtccgccaggtaaccgctctgcttggccgaggccacgctctggagcagccagaacaggtactcgtcggcggtaacctctgtgccatccaccgtaaagagcaccgtgtccctggtcacaccggcggtctgataggccacgtcggacgggtccacctccggcgcgccgggcgcgcaggctgtcagtccggccacgagcagcgccccggtcatgccggcgcacagaaactgtttcacgttcatgcgtgtttgtcctccttatttgggttccaaaagcctgttccagtgtacaccatttccccagcggatacaaccggaagttttgcgcgccgccctacggttccgctttgggggcgttttcggcgtagtcctccaccagcctgcggccaaatttcagggcgtcttcagccccagcccgccagcagcgggccgggggccccgtttcatttcatttcgctgggcggaagtgaatcccgcccagctccgccgcacacgcggcgccggctgccgccggcagggggagtccgccccccgctctatccctctgtctcagccggggcggtcttggcgtagtcctccaccagcttgcgcccgaatttcagggcgtcctcagccccagcccgccaggagcgggccgagggccccatttcatttcatttcgctgggcggaagtgaatcccgcccagctccgccgcacacgcggcgccggctgccgccggcagggggagtccacccccgctctatccctctgtctgagccggggcggtcttggcgtagtcctccaccagcttgcggccgaatttcagggcgtcctccccctttttgagccgcagggccagatagggccgctccccggcggagaagagcaggcgggagcggtacttctccaggccgcacagggcgctcacccgctggagatcgaactggtccagatagaaattcaggttggcgcccttctggtcaatctgggagatcccgttccgggcggcatcggcgcggagaagagccacggagatgaggttgttgaccgtgcggggtgggtcgccgtagcggtcgatgagctcatccatcacgtcgtcggcgtccgcctcggagcggatggcggcgatgcggcggtagaggtccatccgctgctccggcgagggcacatagcggtctgggatggaggcggccacactgagatcggcggcgcactcggtggggcgctccggcttctcgccccgctcctccagtaccgcctcctccagcagcttgaggtacatgtcgtagcccacgctgagcaggaagccgctctgctccggccccagcacattgcccgccccccggatctccaggtcgcgcatggcgattttgaagcccgagccgaactcggcaaactcccggatggcgcccaggcgcttggaggccacctcggtgagcactttgccccggcggtaggtcaggtaggcataagccctgcgcgtggagcggcctacccggccgcggatctggtggagctgggccaggcccatgtggtcggcgtcctcaatgatcagggtgttggcgttggcgatgtcgatgcccgtctcgatgatggtggtgcacaccagcacgtccacctcgccgtcgctcatgcgggtcatcacatcgttgagctcctcctggctcatcttgccgtgggccaccgccacagccacgtcctcccccagcatctccttgatgcgggcggcggtgcgggtgatggtctccacccggttgtggaggtagtacacctggccgccccgctccagctcccggcgcatggcgtcggagagcaccccccagtcgtgctccagcacataggtctgcaccggctggcggtccatgggcggctcctccagggtggacatgtcccggatgccggagagggccatattcagcgtccgggggatgggggtggcggagagggtgagcacgtccacctgcttggacagctccttgagcttctccttgtgctggacgccgaagcgctgctcctcgtcgatgaccagcaggcccagatccttaaatttcacgtccttctggaagaggcggtgggtgccgatgagcagatcaatgcccccctgctccagccgccgcagggtgtccttcatctgggtctgggtgcggaagcggctgaccacgtcgatctccaccgggtgcttggcaaagcgctgcttggccgtcaggtagtgctgccgggccagcacggtggtgggcaccaggatggcggcctgtttgccgtccagcacacacttcatgatggcccggaaggccacctccgtcttgccgtagcccacgtcgccgcacagcagccggtccatgggccgggcctgttccatatcctgcttgatctcggcgatgcagcggagctgatcgtcggtttcggcgtactcgaactcgtcctcaaactccttcatccagggggaatcgggggagaaggcgaagccgggctggcgctgccgctcggcatagagctgaatgagccccttggccagatccttgacggccttcttggcccgggtcttggccttctcccagtcggtgccccccagcctggagagcttgcgggtctcctgggcgtcctccccggagccgatgtacttgctcaccaggtcgagctgggtggcggggacgtagagcacgtcggccccggcgtaggcgatcttgacgtagtccttctgcaccccgtccaccgtcatcttggtcatctccaggaagcggcccacgccgtggtgctcgtgtaccaccaggtcgccgggagacaggtcggcgtaggagcccagcttctgccggttggtcaccggcttgctcctgcgctttttgcccagcagggactgcccctcggtgagcacggcgaagcgccccaccgggtactccatgccggcagtgagcccccccacggcaatcaccgccttgccgtagccgggcagctcgtggagctggaaatccacggcggtggtcatcttctgctcccgcaggagggcctggaggttgagggcacgctgctcgctgctcaccagtaccacggtgcggaatccgtcggagacatagtgggccaggtcggagacggcggtctccaggctggcgccgtaagaggggagctgcttggtcagcaggttgagcagggtgcggggccgctgggggtaccgggaggaggtgaaggcgtccaggtagcagaccggccagtcggccaacacctcggtcagctcctcaaaggtgcgggcgaagtcagccagctccccggccagctctccccgctccatcagggccttggcgtcctctcccaactgccacaggtagctctttccccgctcggccacccgggggctctcgctgagcaccaccaccgcgtcctcggggaagtaatccgccgccgtggccatgacggggtagatcagggcgatgtagcggtccatggccgggaaggccgtgctggccgccagccgctcccggtcctcctccagcgtctgcaccagtgtctcgttccccttgcggcgctttgcctgggaaatgagacggtccagcccctccagcagcccgccgtacccgccaggggtaaactggggcagcacctccgccgccggcaggatctccgccgcgccgaggttctcgatgcgccgctgggtgtcgggatcgaagaggcccatggcgtcgatttcgtccccgaagaactccacccggacgggcttggggtgggccggagagaaaaagtccaggatgcccccccgcagggcgaactggcccacgccctccacctgctcgcagcgggtgtagcccgcggcggccagggtgccggccagctcccccaggtcgtgccgctctcccatccgcagaacctgggccgcctgggtcagcagggttttgggaatggtgcgctggagaatggactccaccgtacacaccagcagggggcactcccccgccgccagcgcccgcagggtggacagccgccggtgctcgtactgccgggacaccaccgcggcgttgtggaaggtgaactcccgggcagagagtgtgcgcaccgcctcccccgacagggcggccagatccctggccatgcgctcggcctccccctcgtcggcgcacaccaccaccacggggcggttcagctcctggcggatgcccgcggcgaagtgggcgcggtgcaccgccgacagcccggaaaaggccgccggacaggccccgttgtcgatggccgccagcagggagcggtattcaggtatgtcgttgagggcggagagcagtggcttcataggacacctcggcacagaaaagatcggaagttgtgggcgcgggccgttcggaggcccggcgtgggatgggcggcggggagtctcagaggcaaatcttcatccgccgctcccggtagaccaccccgtcaaaggtatactggatctcccggacggcgcggaagcccagcttttgatacatctcatgggccgccgtattctccagctccacatggaggtagagctcccgcacccccatgtgttccctcataaagtccagaaagcggagcacggcctctttgcccaggccccgcccctggtactgcgcgccgatcatgaaccggctcatgcaccaccctggaagctcggggtcataatcaaacaggacaaatccgaccatgacgccgtcggaatagacggcacgggtatacaggccctcttcaaaccgggcctcggctagggagcgggcgttatccgccacaaagccgcgctgctcgtccttcacctttaggcagatgcattccatatagttgcttttatcaatttcccgaaaggtgatcatggcgcactcctcagccgttgaagcggttcatggccttgtccggcccctcctgaatgaggcactccaccgcgtcggcggccttacggatggcctctgtgatggtcttgagatcctccccggcgaatttggagagcacccagtcggccatgtcgtagtctgggtggggcttctggcccaccccgaccttgatccgggggaactggtcggtacccaggtgctggatgatgctcttgaggccgttatgacccccggcggagccgcccttgcggatgcgcagcttgcccagggggagggacacgtcgtcagagatgaccagcacccgctccggtgggagtttatagaagcgggcggcctcccccaccgcctcgccggacaggttcatataggtcaccggcttcatgagcagcaccttgacgccccccacctccaaggtgttggtaagggcgcggtgcttcagcttctgcacgggcacccgggcccgctcggccagctcgtccacggtgagaaagccgacattgtggcgggtattctcatatttttcgccggggttgcccaggcccaccaccagccattcagccccggcgccccgatttttgtcaaaaaacaacgtttttcctccatgcggcaatgggggcggagcaacgctccgccccccgccatatttgtactatcctgtccgtcttatacaaagagtttcgagacagacacttcctcgtagatgcgctcgatggcctcggcaaacatgtgggccacggagagatacttgatcttgtcgcaggcgacgccagccttggggggcacggtatccaggaagtagacctccttgaggacactcttctcaatgcgctccacggcggggccggagagcacgccgtggctggcgcaggcgatgacgtccaccgcgccgcccagctccaccagggcctgggccgcgccgcagagggagccggcggtgtccaccatgtcgtcgaagaggatgaccttcttgccccggacgtcgccgatgatgttcatgacctcggaggagttggccttctggcggcgcttgtccacgatggccaggcccatgcccagcttctgggcaaaggcgcgggcgcgggccacgctgcccacgtcgggggagacgacgatcacctcgtcctccctgccgttaaagcggtcgtggagatagttggtgaaaatggggttgcccagcagattgtccacggggatgtcaaagaagccctgaatctggttggcgtggagatccatggtgaggacccggtcggcgccggcgcgggtgatcaggttggccaccagcttggcggagatggggtcgcggggcttggtcttgcggtcctggcgggcgtagccgaagtagggcatcacggcggtgatgcggccggcggaggcccgcttgagggcatcgatcatgatgagcagctccatgaggttgtcgttgaccggggagctggtggactggaccacgaacacgtcggagccgcggacggtctcatagatggagacaaagttctccccatcagagaaggcgcccacctcggcgttgcccagctccgtgcccacctccttgcagatggcctcggccagggggcggttggaagtgccggaaaagatcttgatgtccttaccgtgtgcgatcattcttgtaacatcctctcacattttttctctatcctgtatcccgcggctgcgggaaagagctactttctgcggttgcgccgcttggcggcccactgcttcttgacggtctggcgggtgcgggcgatggccagggagtcggcgggcacctcgtcggtgatggtgctgcccgcagcggtgtacgccccctcccccacccgcacgggggccaccaggttggtattgcagccgatgaacgcatggtcgccgatgaccgtgcggaacttgctggtgccgtcatagttcaccgtgacagtgccgcagccgaaattgacgtggccgcccacgtcggagtcgcccacgtacgtcaggtgggagatcttggtaccctcgccgatggtggagtttttcagctccacaaagtcgcccaccttgacgccgggccccacgtggcagttggggcggatgtacgcgaaggggccgatcttcaccccgtcgccgatggtgctctcattgagctgggaggcgttaatggtgacgccatctcccacggtgcagccccgcaccatggcgttggggcccacctcgcagtcccggccgatgatggtctccccccgcaggatcgtgccgggcagcaggacagtgccctcccccaccttcacccggggacccacatagcaatggctggggtccataatgcggactccggcttccagcaggcggcgcacaccgtgctgccgggccaccatctcagcctccatgcggccgttccagccggagcggatgggataggcgccctggaaccagacgccgcggctgttgaagcggtcgcccttctccttcagggcctcctccaggccaacgccctcagccagagtctgggacagcaggccgccgtcgatgcggtacacgccggtgtccttgctgtcgagtacgccgccgttctccaggccggccagcgtccgggcatccccccagtccagcagcaccggcttggtgatcacgatcaccttgccctccagggcgttgagaaaagccgacagctgctccaccgcgtcgccgctgccgccggtgacaaactcggtgccggcggggaagcaggccgccgcccgggcctggtcgtcggtgtggcagaccacgaaaaaccgctccactccggcggccctgagcgactccgccagccacagggccgcgggatcgaagaggagctcctccagcatcagggacgggccgttgccctcccgtggcaggaatacgaccgctccagtcgcgttcatgttgaaatcacctcaaaaacatggatttcttgcaatcagattatagcaaagcaggactgaaaatgcatcggaaatttcaaaaaaagcgggtaatttttcgctcttgggaggcttgcacaatttcccgcccttttttccgttcctttctttgcaaaacggcccctcgccgtccccatttaaaaaacaaaagcaagcctgtcagagacaggcttgctcacgcgccgctcaaaaccgcccggcgcaggcccaggttccgccagatctgcatgatttcagccgtggcgcacagcttgtcggccaggcagaccgcggccgcctcgcggctgcggggcgcccggcgggacaggggccacatgtgggccaaaatgcagtttttctcccgggcggtcaggccgccgcacagcgcggccgcattctccgcggcggccaccggatgggcaaagcactgccggtaggagggcagggtgcgggggtcgtagagatacaggtcgtggagcagccccgcccgcgcagcggtgcgcgcgtcggccccccaccggtccgccagataccaggccacataggacacaaagacactgtgctcatagcaggacacgccggggtggtgccggatggacttcatatgctgcacctgagacgaaaacagcagctcctccacacaggcacggtactccatccaggccctctggttcatgggtgtcacccgctttctcttgataaggtggttctattatacgcctatcccgccctgttgtcactggaaatttggcggattctgccccgggactgcgggctgttttaaaaaaacgtcagaaataattaaaaactttccctccggcggcgtgtatactaagtgtactatttcatgtaatacagtttctggaagggagacgacggtatgatccaactcaattaccgggatgcgcggcccatctacgagcaggtcagggacggcctgcgccatctggtggtgaccggggcgctccaggcgggagacaaactgccctccgtgcgggcgctggcctcctcgctggccatcaaccccaacaccatccagcgggcctatgagtccctggagcaggagggctatctctacacggtggcgggcaagggctccttcgccgccccccaggccgacgtgaatgcagccagaagggaccgcctgctccgggaatttgacgcctcggcggcggagcttctgttcctgggcatgaccgcgggggagctggccgggcggctggaggcggcggcccggcagactgtgagagaggagcgcagctatgattgaagcaaaaaatgtggtcaagagctttgacgggttccgggccctggacggactgaccatgacggtgccccacgggtccatctacgggcttgtgggccccaacggcgcaggcaagtccaccctgctgcgccacgtcaccggcgtctaccggcaggacagcggctcagtgctcatcgagggcaacccggtgtacgaaaacccggcggccaagtcccgcatcgcctccatccccgacgagctttactatttcctctccgcctccacccgggacatgatgcgcttttaccggggcttctatccccggttcgacgtcaagcgctacgaggcgctgaaggacgtgtttaccaccattccggaaaagcagcccatccggcggctctccaagggcatgcagaagcagtccgccttctggctggccctgtgctgccggccggacatcctggtgctggacgagccggtggacggcctggacccggtgatgcggcggcaggtgtggtccctgctgatgggagacgtggccgaccacggcaccacagtgctggtatcctcccacaacctgcgggagctggaggacgtgtgcgaccatgtgggcattctctccagggggaaggtgctcattgagcggagcctgagcgccctgcaggagaacgtggtcaagatgcaggtggtgttccaggagaaggaattgccccagcttcccggggacctccaggtgctccacgtctcccaggtggggcgcatccacaccctcatcatccggggcaacgccaccgagatcaccaaccgtctggccgccttcgcccccattctgatggaggcgctgcccctgaccctggaggagatctttatctatgagctgggaggtgaggactatgcggtccgcgacatcgtactttaattttaccctgctgcgcaagaatttcgcccgcttctggcccatctggtcgctgtacggcctgttctggctggcggtgctgcccctcaatattttgtccaaccggatacattgggacgggggaatggcccgcagcctgcccctgaactacctggacggcggcccgagcgccgccgttgcgctgaccgctctgttcggcctgctgtgcgccatggcggtgttctcctacctctatgccagccgctcggtgggcatgcttcacgccctgcccctgcggcgggagggcctgttcctcaccaactacctgtcggggcttctgttcctgctgctgcccaatctggcggtgttcctgctggccctggcggcggaggtctttgccggcacagtggtgttcagcagcctgttcacctggctggtggtggtgagcctgttcgggctcttcttctactcctttgccgtgttctgcgccatgttcaccggccacgtgctggccctgcccgccttctatgtggttctcaatggcctggccgccgggctgtgctgggtcttcagccgtatggccgaggaatttctcttcggcttcaccagcgctgcctggctggagaagctgggcgtctggctcaccccggtgctgctgctctccgaggcctgtcacgtccagtatgataccataacggacgccgccggaaacagcatgctgggcgatccctactttgccggtctgggctatgcctccctgtacgccctcatcgggctggtgctggcagggctggccctggcggcctaccgccgccggcatttggagagcgccggcgacgtggtcagcgtccgctgggtgcgcccggtgttcaaatacggtgtggccttctgcaccgctgtgacactgagcactgtcttttactacgttttggaccctctgctgccccgcgggccgtggacgctcctggttctcatggtggtgtggggcgcggcgggctgctttgtggccgagatgctgctgtgcaagagcttctgggtattccggggcgcgtggaagggctgcgtggtctttctgtgctgcctgacggccgccatgtgcgcgatggagttcgatataaccggctttgagggccgggtgcctgacgccgctgaggtacagagcgcccacctgtccggcatggagtccgccccctatgacgacctgggctacgccaccctcaccttggacaccccagaggagctggaagcccttaccggcctgcaccagtccattgtagcgcacaaggaggagctggaggaggcgggctgggagagcacctggtcggaggacggcagcggcctgagcatccagtccgacggctggacctatgtggacatttcctataccctcatggacggctcctatctgacccggaaataccgggttcccctcagccagtccgagctggacacgccgggcacccccgccgcccggctggacgccctgctcaacgcccccggcctagctggtgaatcttacttccacgcgcagcgggagggagaccggctggtggacgcctggctcaccaaccccgatacggacagcgcgattgtccccgcctccgccctgaccggactggaggaggccgtccgcgccgatctggccgagggtaccctgggccgccgctatttgctggagaaccgggaccggctggaaaactgctactacaacgacctctacctggagttccggcccgccggacgcaccggcggcgaggaggaggacggctacacggtctgcatcaccctccagtccggggcccggcacaccctggccgtactccaggcctgcggtctggacggcacgctggtcacccaggcccagattcagaaggaggacgccgtctacgcccaatccacaacggggcgcggctgagacaggccgggcggttcggcaaaacccgaaccgcccggttttgtttttttaaaaaacctgcccttaccaatttaccagtggttgattttttaaaaacggaggggtataatcaaacccgaagggtatttttcggtatggggagaaaatgaaattacgatctggaggtttactgcaatgaaagaagtgtatgtggtcaactgctgccggacggcagtgggctccttcgggggcagcctgaaggacacccccgcaacggagctgggtgccgtggtggtgaaggaggcgctgaaccgcgccggagtgaagccggagcaggtggacgagctgatgttcggctgcgtgctcaccgccgccctgggccagaaccccgcccgccaggtgggcgtgaaggcgggcctgccctactccgtgcccgcctacaccgtgggcatggtttgcggctccggcatgaagagcgtcatcgagggcgcccgcgccatcctgtgcggcgatgccgacatcatcgtggccggcggcaccgagaacatgtccgccgccccttacgccctccccgccgagcgctggggcgcccgtatgggcgacaagaaggtcgtggacaccatgatcaaggacggcctgtgggacgcctacaacaactaccacatgggcaccactgcggagaacatctgcgacgtgtggggcatcacccgcgaggagctggatgccttcggcgccgcctcccagcagaagaccgaggcggcccagaaggccggacggtttgacgacgagatcgtgcccgtcatggtcaagaagaagaaggaaatggtggagttcaaggtggacgagttcccccgcgccggcaccactgtggagagcctgggcaagctgaagggcgccttccccgtgggtccggagggcgtggaggacgagattgtccacacctttgagcccacccaggttcacgcggatgacgcccacaagcatgtgcagcgggtgactgcgggccaggccagcggcatcaacgacggcgcggccgccattgttctggcctccaaggaggccgtggagaagtacggcctcaagcccatggccaagctggtgagctggggccacggcggcgtggatcccaagatcatgggtgtcggccccgtgcccgccagccgtcaggccatgagcaaggcgggccttaagatcgaggacattgatctggtggaggccaacgaggcctttgccgcccagtccatcgccgtggcccgcgagctgggcttcgacatggagaaggtcaacgtcaacggcggcgccatcgccatcggccaccctgtcggctgctccggcgcccgcatcatcgtcaccctgctccatgagatggccaaacggcccgatgccaagaagggcctggccaccctgtgcatcggcggcggcatgggtgttgccaccatcttcgaaaagtgctaaactaagcgggaggaagggcggcggaccgtccttcctcccaactataacgcgaacaccccactctaatttgaactaggagggtaacactgtgcgcaataagattatttctgttgcggaggctgtggacatgatccccgacggggcgaccatcatgtacggcggcttcctgggctgcggcagcgcccatcacatcatcgaagctctggctcagaagggcaccaaggacctgaccatcatcggcaacgactgcggcatggccaccggccccaacggcgaggaattctacggcgtggccaagctggtgcacaaccatcaggtcaagcacgtcattgccacccacgtgggcatgacccccgacgtgggcactcagggcatggtggacaagaccctgaccgtggatctgattccccagggcactctggcggagatgatccgcgccggcggcgccggcctgggcggcgtgctcacccccaccggcgtgggcaccatcgtggaggattcccccttctgcctgggcaagcagaccattgacggcagagactatctgctcatgaagcccatccgtgccgatttcgccctcatcaacggctatcttgtggacaagttcggcaacatctggtacaagggcacgacccgcaacttcaacatcgtcatggccaccgccgccgacgtggtgatcgccgaggcggacaatgtggtggagatcggcgacatccagcctgagaacgtcgtgacctccggcgcctttgtcaactacatcgtggatggagggaatgcgtaatggaaaagtctgagatcaagggctttattgccaagcgcgtcgcccaggagctgaaggacggcgacgtggtcaacctgggcatcggcctgcccaccctggtacccgcctacctgcctgagggggtgcatgtgattctccagtctgagaacggcatcatcggcaccggagccaagcccacgcccgaggaggccgacccccgctataagaccgacgccggcggacagcccgcccaggccgctcccttcggctgctacatcgactccgccacctccttcggctttatccgcggcggccatgtaaacgccaccattctgggcggcctggaggtagacgaggagggctccttgtccaactggattatccccggcaagaagatgcccggtatgggcggcgccatggatctgctggtgggcgccaaggaagtcatcgtcgccatggagcacaccgccaagggcaaccccaagatcctgaagaagtgcaggctgccctacaccgccgtccactgcatcaccaagatcatcaccgagatgtgcgtcatcaacgtgaccgacaagggcctggagctggtggagatcaaccccgagttcactgtggagcaggtacaggccgccaccgaggccaccctgatcgtctcccccgacctgaagcccatgtgctgattgtcaaaaagacctgcggcaaatgccgcaggtctttttttcgtccgggcggggcgatgcgggtaccgcccccctaccgcctgtgatccagccccagcagataatccacacttaccccataataccgggccagagcaatcagcgtctggctgggaatatccaaacgcccggtctcataccgggaataggtggcctgactgaccctcaatatctttgccatttccgcctgggacagatcatgatcctcccgcagttccgccaatcgcgggtacataagcatcaccggtaatcagcatatatcatgcaaaaactgcatattgcattttatgcactttttgcataaaatagtcttaggtgataaggatgtataaatatgaaattgtagacggacaggtatgcgggacttgcgtccactaccggcagcactatatttaccgggatggcagctatttccccctttggtacgggcactgtcattgtccacggcggaagatccgaacctcggaccaggtatgcacgtattgggagccaattccgcacggcccgtaggggccgatgccctcatcggcccacaaaacgggagacgcccgacaggcgtctcccgtttgtctttattccccttttcccacaaacctgtgggcctcgtttaccgcccgctccacggcgttcagaatgttttgatagccggtgcagcggcacaggtggccggagataagcttgcgcagctcctcccgggtgtactgcttgccggagcccacgatctccacggcggacatgatgatgccgggggtgcagaagccgcactggacggcggcctcctccacaaaggcccgctggatgggggacaggcccccatctgcgtcctggaggccctccacggtgaggatgctcttaccctgggcccacacgcccaggtagatgcaggagtcgatggccgtgccgtccaccaggacggtgcaggccccgcactcccccacctcgcagcccttcttcacgctggtgaggcccagccgctctcgcagcacgtcggccagggactcccgggggtcgatacccacctccacgggcttgttgttcacggtacagcgcagcacttcgatcatacgtcggcccctcccttccgggccgcctcccgcagggagcgggcggacagctccttgaccagctggatgcggaactccttggacgcccgccagctcgtgcgggggttcacgtcggccagggcggcctcgccgatggcggcgacggcctccccgatgggcaggccccgcaccgccgcctcggcggccggagagcgcatgggcaccggcccggccacgccaaaggccagggccgcgtcgtccaccatttttttgtcgctggtgagcttcaccaggcagctcacccccagggtggcgatgtccatggcgttgcgctgggcatatttgatgtagtggccggtatagccgacatagttgtcgtatgggatgacgattttcaccagcagctcatagggggccagggccaccttgcccaccccctggtaccactgggagatgggcacctcccgctcgcccttggggccgcgcacccgcagcaccgcgtccagggccaccagggtggaggccgtgtcggcggaggtaatgccgttgcacacgttgccgccgatggtgcctgcggcccggagctggggtccgccggccatgtcggccgcctcccccagcacggggattgtgcggcggatcacgtcggaaaaggtgacgccgcggaaggtggtcagggggccgatctccacgtcgccgttgtcagccagcgtcacgccggagagctcctctcccagctcgtggatggacaccagggagcagcccgccagcttcccctcccggatcttgatgagcacgtcggtgccgccggcgatcaccacggcggcgggatcggcctggagggcgcggatggcgtcgtccaccgacctggccgaatagatggatgcaatgtcatacatgtcagatcagccctcctctcgtaaattcctccaccagcttctggggcgacaggggcagggtgtttaccgccacgccggtggcctggagcaccgcattgcggatggccggggccacggggatggtgggcggctcgcccagagccttgtttccaaaggggccggagggatcgtcggtctccacgaacagggcggtgagctccgggtggtccatagaggtgggcatcttgtagtccagcaggttgccgttgagcagccggccggtcttggggtcgaacttcatctcctcggtgagggcgtagccgatgcccatgctcatgccgccgtggacctgggcctccgccagggcggggttgatgagcttccccgagtcgtggacgttgacgatgcgcagcaccctcaccttgcccacgggtatgtccacctccacctcggcaaagcagcagccgaaggcgaaggtgttctccttgcagtggttggtgtcctcggcggtgatgtggacgctgtgctccagggagtagaaggcgttcatggccaggtcggccagggagatgagggcctcccccgccccgtccacaacctgccgctcccggatgtccagtcccgatgcgtcgggaaatagctcggcggcgtaggcgaggagcttttctcggaactcctcccccacctttttgatggccttgccggtgacgtaggtctgccgggaggcgtaggccccagtatcaaagggggctgtgtcggtgtcctggaaggagacaatatgtacgtcctcggtgggaatgccgatggcctgggcggccatctgggagaacacggtgtcgcccccctggccgatctcggtggcccccaggtggagctgcaccgtgccgtcctggttgagcaccatacgggcggaggccgtctccagggagatggggtacacgccggtcttgtaggagaagcaggccatgcccacgccccggcgcaccgggccggtctggttctggtacttctcccgcagctccgcccagccgatgaagtccgcgcccttctcaatgcactcggccaggccggtggagtggcaggtgatgccgttgaaggggtctacatagcccaggggcatgaggtttgccagccggaaggccttgggatcccagcccttttcccgggcaatgtcgtccatcatgcactccacggcaaagttgcactgggggatgccgtagccccgcatggcgccgggggcgggccggttggtgtagacggtgtaggccgtggagtggtggccgatccggtccagatagagctgccggaagccggtgacggcgttggccacgatggagtggccgtgggaggcgtagcccccctggttggagacggcggtgcaggagcgggccatcaggcgcatgtcgccgtccaccgccgccgccacgtcgaaggagatggggtggcgggagcgggtgttctggaaggtctcctcccgggacacgtccagccggacgcaccggccccccacctgggtggtgagccaggcgttgaggggctcgtagagcacctcctgcttgttgccgaagccgccgccgatgtagggcttgatcacccggatggagccccagccgatgcccatggcctggccgatcacccggcggacgatgtgggggatctgggtggaggtgaccaccacgatgcgccccccctccatccaggcgtaggagatggggttctcgatgtggcagtgctgcacctgctgggtgtcgtagcgcccccggaactggtaataggcggggcaggccagcacgtcctccacgctgtggaagtccgactccggcatgggcgtgcggagatccattttggccaggacgttgtccgggtgctcctcgtggagcaccggcgcgccctccgccatggcctgctccgcctccagcaccacggggtactcctcgtactccacccggatgagctccagggcccgccgggcggtgatctcgtcctccgccaccacggcggcgatgtcgtcgccgtagatgcgcacgcggcggttgagcagcttgcggtcggacacgtcctggtgggccttctccacgctccaggggtggccgggggtggggtactggatgtccggcacgtcaaagcaggtcagcaccttcaccaccccgggcagggcctgggcggcggagatgtccatggacttgacccagccgttggcaatggtgctgtggagaatcttcgcctccagcaccggacgggggcagagatcgtcggtatatttggcgcggccggtcaccttgtcggcggcgtccacgcgggggatgctcctcccgacttccataaaacgcacctccttctgtttatgcctccagtataccgcaccgggcaggaaaaggaaagcccgatctttccccgcgccgcattccactaaatcaggccccatacccttattttttgcggcacccagccgaattaagagtagggttattttcctgtttctcaatagttatgtgttgctgcctggcacaggagtccaaggcgtttccccgatcaacaaggaaaagagtgatatggcttgtataggattgcagtttgtgacgacaacccggaaattcttacccaggtctgtaccacgctgagcggttcccccctgggaaaggaactggagctgacccccttccattccggtgcggcgctggctgccgccctgcggagtggagcccggtttgcgctgcttatcctggacatcgaactggataccgtggacggcgttgccattgggcgcctgctgcgggaagagctgcgggattctgtgacacagcttttgtatatctccggccagcagcagtacgctatggctctgtttgatacccggccgctcaattttttgctcaagcccctagacgaggcaaagctgctggattgtgtggttcaggccatccgcctgtcccgtcccgaagaggccgtgcttaccgttttagtggagcggacgccccgcgccctgccgacccaggccatacgctatattgaaagttaccataagcggatcaccgttcattccgtccagcatgaactggtgtgccgtgacaagctggacactgtggcccgccagctcccggagcagttttttctgcgtattcaccagtccttcctggtcaacaccctgtatgtccgccgcatccaatatgatcggctcactctggacgacggaacagagctgcccatcagccagtcctaccggcgggtggtgcgggggcgcctgctgagatggactcccggggggatggtgctatgaccgacctgcaaaccgcctcctacctgctcattaacgggtttcactggtacctctacggccgcctgctgaccctctttttgggccagcgcagggtgggatgcccggcagaggcggcaggctacctgtgtgcctatgtactcaacagcctgtgctttctgttggtcggcgtccccctgctgaacctggcctcctccctgctccccctgctgctgctctccctgctctaccgtgctccgcattggcaaaggctgtggtctgcgctggtcatctacgccgccagctttctgctggatacattggtctttctgctaatgcctgcccatacctcccagcttggaaacctggtatccgccctgctcctgttttttatggccctggtgttggaaaagcgttgtccctcttccgaaaaagagcttcagccggacggccccttctactggttcgccgtacttctgattccctctacctccattgccatggtcatacttttgttttactttgcccactgccctgcctggctgtccctgcttgtggatgggatgctcattcttctcaacctcctggtattccatctctaccggcaggtgggacgcagctattacgcgcagtaccgcgcccgtatactggagcagcagaatcaggcctatgccaacgaagtagccctttaccaatgcggggaacgggagctccgcaccctgcggcacgatatgcgcaaccacttggccgccctacatttgttggccggccagcaggacaccggagcactgcagggttacctggaacagttttcgaaatgtttagagccctcggccctctgggccagcagcggcaaacccgaactggacagcctgatcaacttcaagttagccgaggcccggcgggcaggggcgcaggtgcgggtagagctccgcctccccgcagggctttcccttcccctctttaccgtcaacactatcttgggtaatctcctggataacgcggtggagggactggcccgttgcccccaaaaggagctgtccctcgccctgtgggcggacaggggcctgtgccgcctccgtgtagagaacacctttgacggcacgcttttgcaggatcacgagggcaactttaaaacgagaaaggcaggaacctccctgcatggtatggggctggacagtgtacgccgggccctgtcctctctggacggctttttacaggtacggattgagggccgccgcttcattgccgaggccatctggtatctgcccgagcacccccaaacgacggatattacctcttaaacgacggaatcggcaaactgggtagacggtaccctatgtctacgctataatagcaccactgtttgcagaaaggtgttattaccatgaaaacctaccatatcactttacaaggccaggactacaccatctgtttacgatcctactccgtggaaatcaacggaacgcgctacaaaatccgctctcttccggcgcggaagctgctgtttctgaccatggaggtggatctcccaatttccggcgcccatgtgatgctggtgtccggcctgtggtccatggagctggtggtggacggcgtgatgctgcgcaccggcaagccctacacccccatcggcaaaatcccggtgtgggcttatgtggtatctgcccttaacctggcgcagattatgaacggcgctgttggcggagtgctggccgtgctcggcattttcctgacccttcggctgtccacctccgagaatctggcccccgcgctccgggtcctgttgagcattgcctatctggtggtctcctgggccgcagtctttgcccttgcctttcttctggtgagcggtggaacaatttactattaatacaaagcagaaaccgaaaggagtatgttttgatgcacgagcatcctaattcccttttaaaagtaggctgccttctgtttattgtgggcggccttgcctccgcccttgtcacgctggccggactccttctctcagtggggagcatgatggattccgaactgtatccctatgtcgatcaaatggcccgggcacagagcgacggcctgatcggcggcgacgagataatggctgttttctccggatttgtttttgtaatgggcgcgattgccgtaatcatgctgatcattgatctgacggttggtattctggggctctcccggagccggcggccagaaaaataccgctttttcctgggttggggaatcccactgctggtcatcggcggtattggcaccctgctgaccggggtggttacccccaacggtgttgcttccctggtctgcggcgttgcagcccccattctgtttatcgttgggggcattcagcagaacaaagcctataacgaagcacacacacccacgccctgacgggatctatgtataccatacatatccataaaatccgtaccaaataactgagaggagcttataacatgaacaccgcaaagaaacgcattctttccctgaccctgaccatctgcctggccctgtccatgatgctcaccctgtccgcctgtggcaaaaagaacctggaggagtatttcaacaccgacaccatgcagaagcttgtcacctcttccgttgagcagtacgaatcccaggggatggagctcaaaatgtacgccgagggcgacgagctgcactacgacctcaccctgaccaccattgagaccaccgatgacgaccgctccgtgtatgccgaggctctggaggcaggactggccgaaaccgcccagaccttcgtggacgccgccaaggacgtgcagaagtccgtttccaatgagaccgtcctggtggtggtcacctattttgacgccgccggcgtggagctggcctcccagtccttctcctctgcggactgaacccggtacgcaccgagggagctgcacctgtgcagctccctttttcgctccaaaaaggggagctgacagccgtcagctccccttttgctcctctttttccccggatacgccgccgcccgacagacggttgtaatcggcaaacaggtctgctgttctctgaaggatacctctctgctcctgggtcagcctgcttacatcgagggtaacgctgcccatcctccgccgccccagcagcgaatcggtactcactccaagaatattcgcaatccggatcagaatatcataggagggcagccgcgtcccgttctcgtaggccgacacagaggctccggtcacccccagccggcaggcaaaatcggcctgggtcatcttcattgaggtccgatattccttgatccgctcccctaggtctttcatccatccaacctccgcccttagcctgctaccctattttatcgaatggcaaaaaacatttggttttatttacaagatgttgaatatatacccctgctgtgctatactgtcagtagaattatttccctgtatgccgttctgttcccggatccccctccgccgcgtcttacccggttcaactcccccaaaatacgcggccccgccgcggcgtccgcctttggatgcctgccttcgggcactgtgcaggagatctgcattgccatatcatccgactgagaggagaaaaccaaatgaaaaaacgcattctgtcccttgccatggccgcctgcctggccctgtccatgatgctcaccctgtccgcctgcggcaaaaagaacctggaggagtatttcaacaccgacaccatgcagaagcttgtcacctcttccgttgagcagtacgaatcccaggggatggagctcaaaatgtacgccgagggcgatgagctgcactacgacctcaccctgaccaccatcgagaccaccgatgacgaccgctccgtgtatgccgaggctctggaggcaggactggccgaaaccgcccagaccttcgtggacgccgccaaggacgtgcagaagtccgtttccaatgagaccgtcctggtggtcgtcacctattttgacgctgccggcgtggagttggcctcccagtccttctcctccgcggactgatttccgatctgacccgaggggcgctgcacagatgcagcgcccctcttctcttatgtccggcgcgaattgcgcttgatttctgcccgccttgtgctatcatgggagtatggcaattcggagtaaggaggcttttgcatgatcgacctgaccatccaccgccaagcactggaccgcaacatccaaaaggcccgggagggcggcgtcgtcatccccaccttcgagaacatgaagcacccggagacggtaccggagcccatccgggcccgcctgaggggcgtgggcctgtgggatgtggaccccctgaatctcttccgcatcacctggaagaacgagcccatggagtccggcggactgtaccgcgccgtacccaactacatcgagctgcccccagccctcaccggcgtgcccgcccgcatcatcgccctggtgggcaagtggttccccaccggctgccacaaggtgggggcctccttcggctgtctggctccccggctggtcaccggacagttcgacgccgggtatcaccgggcggtgtggccctccaccggcaactactgccggggcggcgcgttcaactccaagctgctgggggtccggtcggtggccatcctcccggcgggcatgagccgggagcggttcgagtggctctcccagatcgccggagaggtgatcgccacccccggctgcgagtccaacgtcaaggagatcttcgacaagacccacgagctgcggcaggagcccgactgcatgatcttcaaccagtttgaggagatgggcaaccacctgtggcactatcaggtcaccggctccgccatcgccgaggtctttgaggcggtcaagcgccccggcgaccggctctccggggcctgcttcacctcaggcagcgcgggcaccatcggctgcggcgactacctcaaggaggtctaccccggcctgaagctggcggtgggcgaggcccttcagtgccccaccattctggaaaacggcttcggcgaccaccgcatcgagggcatcggcgacaaacacatcccctggatccacaatgtgaagaacaccgacatggtcatcgacatcgacgacgaggactcccagcggctgctgcggctgtttaacgacccggccggccatgactacctgcgggaggccggggtgccggaggagaccctgtcgcagctctccctgctgggtatctccggcatcgccaacgtgctgtgctgcgtgaagctgtccaagtactacgagctgacggagcacgacgtggtggccaccgtcctcaccgactcggcggacatgtaccgctcccgtatccaggagctggccgaccagtatggcccctatgacgggcgggccgccgcggtggaccacgccctccatctgctgggcctgcgcaccgacgccatggcggagctgaactactacgaccgcaagcgggtgcacaatctgaaatactacacctgggtggagcagcagggccgcgacatgcacgagctcaacgacctctggtacggcagtacctgggacgacgtgcaccggcaggccgccgccctggatgagctgatcaccgccttcaacgaggagaccggggtgctcaagcgcctgtaaaccggggcaagcagggcgatgagggcatcgccccctacagccgttaccctcataatgtgtaggggctgatgccctcatcggcccgccgtcccacatccgaaagggggattttatgaaatatgtcctgggcgccaagtgcgtcaaatgcgggcgggagtaccccgccgcgcccggtctgactacctgtgcctgtgggggcatcctggacatcgtatacgactacgccgccatccggcggcacttctcccccaaatctctggcggactgccgcgactacagcatgtggcggtaccggccccttctgccggtggaggaggagtccgcccccccgcccctgcgggtgggctggtcccctctctataaggccgaccggctggcccaggccctggggctggataccctctacctcaaggacgacggccagaatcctacgtcctccctcaaggaccgggcctccgccctggcggtggtcaaggcccgggaggcgggggcggacaccattgcctgctcctccaccggcaacgccgcctcatccctggcgggcaacgcggcggcggccgggctgtccacctacatctttgtgcccagccgcgcccccaggggcaaggtggcccagctgcggatcttcggcgccacggtcatcagcgtggagggctcctatgaggacacctttgagctgtccagggccgccatcgaccgctggggctggtacaaccgcaacgccgccatcaacccctacctctccgagggcaaaaagactgtcaccctggagattctggagcagctcggctggcaggcgcctgattacatcgccctgtcggtgggggacggctgcaccatcgccggggcgtggaagggcctcaaggatctgtacgcggccgggttcattgaccggctgcccaggctcatctccgtgcaggcggagggctgctgccccctgaaccgggccatcgagacgggaaagccttgggaacccatggcggagaacaccctggccgactccatcgccgtgggggtgccccgcaacccggacaaggccctctgcgccatccgggagtcggacggcgtggccgtcaacgtgtccgacggggagatcctggaggccatgcgcctgctgggccgcacccagggggtgttcggcgagcccgcgggggcggccggcaccgccggggtgaagaaggccgtggagctgggcctcattcccgccgggagcacggtggtgagcatcgtcaccggcaacggcctgaaggacgtgcagagcggtattcaggccgccggggagcccatgcgggtctctcctgacatggatgccctgcttgccgccttcgccgcccaggacatccggccctgaaaaccaacagagaaaggaaaccacactcatgaacgaccgctccgccaaaataggcgtctgggcctatctgctctttacgcttgccagctttgcgctggctctctatcttttgctggctgaggggggataccgctacaacgtctccctggtcgccctgcccgtctggatgggctataccgcctttaacaccattaagagcgtgtccgatctcatcggcgctcagaaccgaaccgccaacttcacccgtatgctggcccgctgggaggatacctttgagagccgcggcaaagccctggccctgttcacctttatgaccctggtggtgggcctgatcaagctggctgtccccatcctcctgctccagttggggcaggcctttgcctgagcggctgggcgctgtcctcatggcctccggctttggacggcgctttggctccaacaaactgctggcagaggtggacggcgtcccgctctaccaccgggccatggcggctctggcccctgccgaatttgaccgggcagtggtgtgctccccctatccgcaaattctggctgctggtgaacgattcggatttcttccgctctataacggcggtgcggcggaggggatctccgcctccattcgcttgggcctggcccggatgtcggacctggacggggtgctctttgccgtctgcgaccagccatggttgaccacaaagagtatcatccgcctcaaaaaatcctttttggaatcaccagacgccatttacgctctctcctggcaaggacggagaggcaatccagtggtgtttcccgccgacctgtttggagagctggccgcgcttaccggggacaccggcggcggcgcggtcatccgccgccacccggagcggctccggctggtggaggcgttttccccaaacgagcttttggatgtggataacccggaggcactcccctaaaaacaaacggatatcccaccggcaaatgagccggtgggatatccgttttgacatatttccgctgctacgacaccggaatgtgctcccccagaaggagcaaatggtcgatctccgccacctccaccgggcgctccagctcccaggtgttgtaggcgtcccatacctccgcgccggcgccctctcccacgttggcgtagcggcccgcgccgcaggcggcgggcacctcggttccatcctttagaaccaccgtgagctccgccgtgctgaagccgccggtgtcgtcgctgtccatggtgacggtaaggggggagacggtgacgtgatccacccgccgccccgccagggtgcccgtccactccagcaccgccgaggggtagtgctccagcgggaagtcgatgctccacggcccgtcaatgtccacaccggggcgctcatagccgccgtagaagtacacctcccccagctcggcctcctcccccgctttgatcagggggaagagcacgtccaggcccccttccacctgggtgatcaccgtggcgcgccagtatttctcctccgccgtccggcgctcgtccctggggtagacgcgggcgaggaaatagcccatgtccaaatcctcgtggccgatgccaggggcgtaggccacccggacgtggaaccgcccgtcgctggcaaagcccatggaggagatggtcacgtcgccggtgccctccagtggcataggtgtctggccgggggccagcaccacccgctcgtccggcaggatggaggcgggatagccgctctcctccacccccatcaccacccggtccccctcccccaggggcaggctgtccagaagggccgccgtcactccggcgcaggaggcgccggcgtccagctcgccctgccgggtggtcaggcgctccaccgccagatggagcgtgtccgggacggcgccgccggtcgtgccgaggcccaccgcgccctccgtctggggccggtaataggacattccggccgcaaacagggcggtgcggctctccgaatcgtactccaccagccggcccgccagatcactgtccgccccgcagcgcagggtgagctggctgtccagccggtccccctctacgtcgcggaccgtgaagtagacctctccccgcacgtcgtcggccagggcgctgagcacctgtatctcaatccctccgctggtgcacaccgccccctccacggtctgggccagcccggcaaaggggccctggcgggcctgaatatactgccacagggacggccccgccgccacggcggtgacgcacagggccgtgcagaccagcgcagccgctgcaccacggcggagcgcagaaccgccccgtttcgccgtaaaggccttttccctgacagcattttttcggttctcgtcgaataccaggccggccaccggccgctccagcgccttgcgcagctcagtcataataccactcctccagcatgggccgcagcttccgcttggcccgggtcagccgggcggacacggtgcccggcacaatcccaagggtgtctgcaatctcctccagggtaaactcctcatagtagcgcagcagcacgacctcccggtacttccggggcagggagagcacggcccgcaggggggtatcgtcccacggcgcgtcctccgccgccggctcggccagggcggacagctccatccggtgggtgtgccacggggagcggagcagatcccggcacacgttgagggcaatcgctgtaatccaggtgcgctctgccgcctccccccggaaggtgccgtacctccgccacgccctgagcagggtctcctgggccgcgtcctccgccagggcggcgtcccccagctggagggcgcacagccgcagaagccctgtgccgtactcctccatcaaccgctccagaccggcggcgctgcccgcctgatgtgccatctcgctcccctcctctgtcccattctattccattggacgcgccagcgggggattttcatgcaaaagggacggatttctttcaaagaaatccgtccctgagtgatttgttcccggccgtgtcctcctctttattccagggggaaggtctctcccagaagggtgaccgaggccagctcgtccagcgccgcgggcgtctcgaagctccacagcccgaggttcaacccgtcctccgcgcccgcgctcatcatgcccatgggcactccggtccggacgccgttcttatcggtggcccacaccacgaaccaactcttgtccccgccccggtagtagacggcaatattcatgcccgacacctcgatgcgctccacatagaagccgtcctccagggtgcggcccaccgggatcaccctctgctccgccggctccagctccacagggaggctccactccccctcgatggccgcctcggggccgcggtaggccccgtagacccggatggaggccatgtccgccacgtcgtccggcgcaacgccgccgatgacgtagtccatgccgccgtccaccgctgtacgctccagcgtggagcccatctgctcccccgccgcgtcatagggcactgccagcagccagcccgcgtcaaagccctcggccatggccaggcggatgtggaagcgcccctggccgtcaaagcccatggagctgatggtgaaatccgcggtgtcggggctggtctggggggtctgaccgggggagagcaccacggccccctcccccgtggtgtcggtgtccagcgcgcgggcctcggccggaggctggaagcgggcgtcccggatatagcgctcgccggggtcgacgcaggtgagctccagcgtcacggcctggctggtgtccaggcccttcgcgctggcctccagcagcagggtgcggctttcggcgtcgtaagagaccacctggttgccggtgcttcgccccatagccgctctggcgcccttcaacccgccggagacctgggtgtgaccgttgagccggtcgcccgtctcgtcggtgagggtgtagtacacccgggcggtatagccgtcgctgaccgccttcaccagctccagccggaggccctggccggacgtttccccctccacctctgcggcaaagggggcgtagggccccaggcgggcctccagcgcgtcccacagggtggggcccgccgccacagcggtgacgcagagggcggcgcacagggccagggccgcggccgcccggcggcccagccgccgggaccgccgggccggcgctccctcctccagcaggcggttgagccgctccaccgccgccgggctgggcctcagcccgtccatctcccgcctatagtcgttctgaaacatcgtcgtcctccttcaaataccgccgcagcagcgcccgggcccggaacagcctggacttgaccgccccctcgcttttgcccaggacggcggcgatctccgccacactcagctcctcatagtagtacaggtgcaccgccatccggtactgggcgggcagggccagcaccgcctccaccacgccgccctccccgggcggctccggcgcgggcagcccatcgtccagcggcccctccctccgccgccacggggcgcggagcacatcggcggcgcagcgcgcacccacccgcagcagccaggccttggcgtgctcctcgtcccggaactccggcctggcccggagcaggcggacaaagacctcctgcatcacgtcctccgcgtccgcccgggagccggtgcgggcgtaggccagccggtagagcatcccggcgtactgctccgccagggccgccggttcccgccagcgttcctccatgggcctccctcctttctgcctttaacacggcgcggacggccgtttggtttcgcacccgcgcaaaaaaagacggatttcccccatgggaaatccgtctgcccatacgcgggcctctccttaccgtttttcctccgccggggcgggcggccacaagggccgcccctacatcgctgctgcccgctccaccggcgcggcgcacatactgccagtacggaaaaagcgtgggcctgtccccgcccgtcacacccccgcgggctccccggcggcggcgcggaacaccgcctccacgtcggcccgctcggcgtggccctcgtgcaccttcacgccgtccacatagtagcaggggacatagtagtagtcaaaggtatcggcataggcgggctccgccgcctcgtccaccattcggagggggatgtcccgccacgcggggtgctcggccagcagctcctcctggagccggagggccagcttgcagtggggacagttgttcagaagaaacagggtgatctctttcatttgcgcacctcaaattccacgtcgatgtcgcccccgcataccatgcccagctcggccgcgccgggggtcagatcatagtgtctccgcaccgggccgcccccatgcgtccacagggcctttgcctcctggacggccaggtgctccaccgcgccgccgccgatggtgcccagcaccgtgccgtcgggccgcaccagcatccaggtgcccacgtttctcggggcggaaccccgcttggcggtgatggtgcacagcacgccgggttcccccgccgccgggggcgcggccgccggcccccggcgggcccgctcctgcaccagctcggcggcgatggacacggcgatctccgccggggtctgggccccgatggacaggccgatggggctgtgcaccccgtccaggatttcccgggcaatgcccgccgcctccagggcggccttcaccgccgccactttggttctgctgccgatcatgcccgcataggcgtacttcccccggagcacgtgctccaggcagtcccggtcgtgggcgtggccccgggtgagaatcacgtagtagtcgctctcccggctgcccagggcgtccagcgccttcagaaagggggcgcacaccacccgggcggccatggggaagcgctccgggctggcaaactccggccggtcgtcgatgaccgccagctcaaactccagccgctgggcgatgtgggccacctccagggacacgtggccgccgccgcagaggatcagacgctccatagtcccgccctccttccgaagtacaaaagcccctccagcacgccgccgccgatggcccgggccttgtcagagacggtgaagcagtgctccgcccggcaccgggggtcgatgtcccccgccttcatgcccgccgtgacggccagcccggcggggagcatcccccgcaccacgccggtgagctgggcgcaggccgtccggcccgccacccgggccaccggctggccctcctccacccgctggccgatggcggccagcggctcgaacgccccgtccgccggggcgcggatgatgcgctgggtggtgtagccccccacgtcgccggggacgccggtgttgggggcggcgctcccctgggtgagcaggcggcccagattatgcccccgcatggtctccaccacgccgtggcaatccaccccggcggtgaagccggggcccagggccagcaccaccggcgcatcggtgatggccgtgcccaggttgcgcttggccagaatggcgtccactaccccgtcaaagggcagctcccccaaaatggccgccgccggatcgcagagcacgggaacctctccccgctccagcgcccggcgggccgccccggcgtcctccgcccggcgggcggagatcccctccacctgggccgcgccgtcgtacatgcactgggagaaggccaccgtccgacgcaccgccgtgggctgggccacctccgtcatgaccaccggtatgcccgcccggtacagccgcaccgccgcgccggtggccagatctcccgctcccttaatcagaaccagcataatccgccccgctcctcctcccgatagtaggtaatggcgctatgaatgccccgctccgccagccgtccggccaccgcgctggcgtgggccgcccgctcgggggtgtccgccttgttgagtacacagcggaaggccatggcctcccccacgcccttccgccccccctgggggttggccagcagaagggccacgtcctcgggggtgagcacgtgctccgcccccgcgcccagcagggcgcacacccgctccggccggtggcagaccgcccccacggcctgtcccaccgcgtccatgcccgccacggcggccacggcgtcggcgcagggggggatcacgggctcgtactccgccggggccttgaggggcaggcgcttggccccgtcggcctccaccagtaccacatcggccgcccggcgcagctcctccggagttcccgcgccggagagcttgtccccccggaagaccgtccccacggtgaccaccccgtgcccttccagggcggcccgcaggcgctccggcgtcggctcctccaccaggggcaggccggggtggcgcagaatgtgggtggtggtagtgaccaccaccgtccgcccgctgtccgccgcctgccgggccagggcatacagggtggaggtcttgccccccgcccccaccagggccaccatccggtggcgggccatgtccaggcccaactgctcccagatgcccatgctcagccccccgacaggtgctcgatgaggatcttcacaccgatggcaatgagcaccagtccccccgtcagctcggcccgccgctggaacaggcagcccaggcggcggcccaccaggccgccggtcaccgacagggcaaaggccaccacgccgatgaccgccgcagaggccagaatatggacgctcataaaggccatagacacccccacggccagggcgtcgatgctggtggcaatggccagcacgcacagccgccgggcggacaggtcggggggcgcctcgtcctcctccccgcagccccggcgcagggactcccacgccatcttgccgccgatgacggccagcaggccgaaggctacccagtggtccaccgcctcgatgtactggctgacgctgctgcccagcagccagcccagaaggggcataagaaactgaaacgtgccgaaccacagacccatcttaacggcctgccggggaccgaagccggggatggagatgccgctggacacggataccgcgaaggcgtccagcgccaggctcacggcaatcaggaaaatctcaaccaaaccaatcacctgtctgcaaaatattgttaggagagtgaaatttattatagcataccttccatggatatgctataacaattagagatatgaaggcacaacatgggagggctttatggaacacgaggagtacatgcgccaggcgctggagctggccaggctggccatggcggagggagaggtgccggtgggctgcgtcattgtgagggacggcgcggtggtagggcggggccgcaaccggcgggagactgcccagaccgcacttggccacgcggagctcgaggccattgcccaggcctgccgcaccctgggggggtggcggctggccggatgcgccctctacgtcaccctggagccctgccccatgtgcgccggggccatcgtcaacgcccgcatccccgccgtatactacggggcgaaggatgacaaggcgggctgctgcgggtcggtgctcaacctctttgaggagcgcttcaaccaccacccccgcatttacggccgggtgctggaggcggagtgcgccgctctgctccaggaattctttcaatctttgcgctgatttaacgcttttttaacaaggcgtgctcgattttgtaacaaccccctggtagtataacacttgcaagagacagagcttcttttcattctatcctccaatcatgtgacgggcagcgggtgagcaccgctgcccgcctcattttaccggcgctttacataagaagcaaattatttaaaggttctgtaacacattccgatttattcgttaacatctttcgggtattataatactcgcaagagacagtttcttttcatttcattgtatcctctttccttcgataaggccggacgtcaggagcagacgtccggcccttgtcgtttttttgcataaagcagcgcccccggcaaaagccgggggcgctgcttttgtccctcttatccagtaaaacagagccctaccgctcctcccggaaatatgccaggcccaaactggccggcggctgcttgtcgcggttgttgcgcatggaggtaaagaccagcacgatcacggtgaccacatagggcaggatcttgtagatctggtcggggatcaggtcgatgggcatgcgcaggtagagaatgagcaggccgccgaagaggatggaaccccagatggcccggtaggggctccacaggcagaagatcaccagagcgacggccagccagcccacgccggagagtccctcgtggttccaaacgccgcccaccacggtcatgatatacaccatgccgccgatggccgagatgccgccgccgatgacggtggccagatacttgcagcgggtgacgctgatgccggcggcatcggcggtggcgggggactcgcccaccgcgcgcaggtagaggccggagcggctgcggtggaggtacaggcccatggccactgccatggcgatgcccagataggtgaagatgctgtggctgaagagcagcctgcccaccaccggcagctcctggaggaagaccgggaagggcgagccgttgaaggcccccttcagggtgttgctgacggccacgtaggtgccctcccgcacccgcataaattcaccgatgtactggcccacgccggtgccgaagatggtgagggccaggccggtgacgttctggttggcccggagggtgatggtgaggaagctgaagagcagggcagccagcgcgccggccaggaaggaggcggcgatggcgatgaccaccgccaggggggcggacaccgccgcgcccgccagcttctcatagtagaacgccgcgcccaggcccagggcgccgcccatgaacatcatgccctcgacgcccaggttcaggttgcccgacttctcggtgaggatttcgccgctggtgccgtagagcaggggcgtgccgtagaggacggcggccgtgatcaggttgagcagaaaggtcatttcgccgcctccttcctcttgtggcgctcctccgcgccgcggaagaccagcttatagttgatgaagaactcgcaccccagcatgaagaagaggagcacgccggtgatgacgtcggagagggacgcggggatacccatctgggtgttgagggtgtccgcgcccttctggaggacggccagcagggcggatatgcccaccatggcgaaggggttgagctgggccagccaggccacggtgatggcggtgaagcccgccccggcggctacgccggagtacagggtgttgttggcgccggagaccagcaggaagcccaccacgccagcgatggcgccggagaggaacatggtgcgcataatgacccagcccacgttcatgcccgcgtaccgggcggtgttctcactctcgccgatgacggcgatctcatagccgtgcttggtgtatttcatgtagaggaacatgaacaccgtcagggccagcaccacgatccagccgcagtacacgccggccacccggggcaggcaggcgttggaggcgaactgctcaatctgctggctgccccgggggatcttctcccacgggccgccctggagccacttcaccacgccgatgatgatgtagttcatcatcagggtgaacagagtctcgttggtcccccagcgggccttgaagaaggcgggcaccagcgcccacaggccgccgccgatggcgccggcggcgcacatgaggagcagcaggggcacctgggggatggagtcggcccagaagagggcgaaataggtggcgcacatggcgccggcggtgatctgtccctcggcgccgatgttccagaagcgcatcttgaagcagggggcaatggccagggcggtccccagcagggggatgaagttcttcacggtctgccggatgccggaggtcttgcccagggcgccctccacgatgatggcgtagccctggatggggttgttgcccgagagcaggatcaccaggccgcccaccaccagggccagcaggatggccgcgatgcggatgccccactggcccgcgccggccatgccgtcccgcttggccaggcggatcaggggtgttttgccgctgctatgcacgctcgcccgcctcctttccgccgcccacgtgggtcatgtagaggcccacctcttcctttgtggtattccggccgtccacgatgccggagaccttgccgccgcagagcaccaggatccggtcgcacagctccagcagcacgtccagatcctcccccaccaggagcacggccacgcccttcatcttctgctggttgagcaggccgtagatggtgtaggacgagttgatgtccaggccccggacggggtaggcggtcataagcacggtgggggtggagtcgatctcccggcccaccagcaccttctgcacgttgccgccggagagccggcgcaccggggtgccgacgccgggggtgacgatctccagctcgtcaatcagccgctgggccagcgcccggggggccttgcggtccacgaaggggcccttgtgctcccggtaggtcttgagcatcatgttgtccaccatgtccatgcccgccaccaggcccatgcccaggcggtcctccggcacgaaggccagggacacgcccacacggcggatctgcatgggggtcttgcccaccagctcctcgccgtcccggtctacggggacgtggtagccagcaatgtcgctgttggggtggggcgggtaatagagcacgctgcccgcctccgcggcctggaggccggcgatggcctccagcagctccttctggccggagccggcgatgcccgcaatgcccaggatttcgccgccgaaggcctggaaggacacgtcatccagggtcttgatcccctcgtgatcccggcaggtcaggcccttgacctccaggcggagatcccggtacttggcctccggccggtcgatgttcaggctcaccgcccggcccaccatcatctcggtgagcttctgggggtcggtgtcggctgtgtggacggtgccgatgtacttgcccttgcggaggacggccacccggtcggagagggccatgacctcgtggagcttgtgggtgatgatgacgatggccttgccgtcggcgcgcatgttgcgcaggacggcgaagagcttttcggtctcctggggggtaaggacggcggtgggctcatccagaatcaggatgtccgccccccggtagagcaccttgaggatctccaccgtctgcttctccgacaccgacatgtcgtagacctttttgccgggatcgatgtcaaagccgtacttttcgctgatctccttcacccggcgggcggcggcccggagatcgaaggcccccttcccctccaggcccaggacgatgttctgtgccgcggtgaacacgtccaccagcttgaagtgctggtggatcatgccgatgcccagggcgtaggcgtccttgggggagcggatggtgacctccctcccgcccacgcagatgtgtccctcgtctgggaagtagatgccggagatcatgttcatcagggtggtcttgccgcttccgttctcccccagaagggagagaatctcgccgcgccggacctccagatcaatcccgtcgttggccacgacgctgccgaagcgcttggtgatccccttgagctggatcgcgctgacctgttccaaacccagcctcctttcccggcccccgcggggccgaagcgttctcttctctctcactcgctactccttgcggcaaaggcccccggcgcggtcgcgggggagaaatccggggccggcccgcctgggccggccccgcctttgcttccggtttgatcttttgtttactcctcggtgatgccgtcgatgacgtagcagaactgaggtgcggacaggccgccctcctggctcaggtcggattcggggaagaactcgccctcaccgatgctccacacctcgccgtcaggattctgggccgggtggccggacagggggccggcgaacacgtgcaggccgcccgccagatcggcctccgccttttccagcgcctcctcagtgccgggggcggcaatggcggtgttcagctcggtcagcttgacggagccatcggcgtagccggcagtccagtcctggtcaaagctctcaccgttggccacggcggagatggcatagacgaaatagggcgtccagtccacgcggcaggagatgaggctggcctcgggggccacgccggtcatgtcgttgttgtagccgcagtggaacacgccggcgtcctgggcggaggtggcgggggtggtgttgtcggagtgctgggaaatgagcacgcagccctcgtcggccagggcggaggcggcggcggcctcctggggcgcgtcggaccaggagttgacgtacttgaccttcatggtgacagagggacacacgctcttggcgccctggtagaaggcggtgtagccggaaaccacctcagcaaaggggaaagcggccacgtagccaatgacagcctcctcggcggtgatggtgccctcgtcgatcatctgctgcagcttcatgccgccggccacgccggccaggtagcggccctcgtagatgttggcgaaggcgttgtgggtgttgtccagatcgtccacggcagaggcctggttggtacaggagatgaactcgatttcggggtagtcgggggccaccttcagcataaagggctcgaagccgtaggagttgttgatgataatatcacatccatcctcggccagctcgatgttggcgtcctcgcagccggagtcctccaggatatttttcttgtagctccactccacggtaatgccccgctcggccaactgggcggtggcctcctccacggccttcataaagttataggtataaccctggtcgttctcgtcgccgatgcaaaccatgcccaccttgacggttttaccctcggcggagggctcaccagtgccgtcagtcaccggggtggtctccccgccggccggggtgttggcggagccctcgtccccgctgttgccgcaggcggccagtccaacagacatagcgcccgccaggagcagtgcaagcagtctctttttcatcgtttaagttcctccttaattgcgtctctcaatcaatcgggtcctctattcaaaacggctgcctgaacacgggggcactcccccctgctcaccgacgggcgccatacgcgccgaacgccaaaatcatccgctcatcacggagggacgtcctccgcctgcggcagccggtcttgctgtgtaagacaggagcccggaggctccccgacgaaccgtaagacctcggttcatccggcggaggcgcccgcctccgcttttctcttcgctttctttcctccgccctcccggcgggcggccacaagggccgcccctacgggatgcggcggctggggctgtgggctcagcagaactccacgccgccctccacgctcatggctttgatgcgggccagggactccacccggactcccataccgcggatcagatcgccgccgggctggaaggccttctccacacagatgcccgcacccaccagggtggcgccggcatcctgcaccaggttgatgaggccctgcagggccgagccgttggccaaaaagtcgtcaatgagcagtacccggtcctcggggtacagaaactccttggacacgatgatgtcgtacaccttgccgtgggtaaaggactccaccttggaggtgtagacatcgccggcgatgttgcgggtcttgttcttcttggcaaagatcaccggacaatcaaaaaactgcgcggttacacatgcgatcccgatccccgatgcctcgatggtcaaaatcttggtaaccccgcagtccccaaacaagcgcaggaactccttgcccatttcctggaacagcttcacgtccatctgatgattcagaaagctgtccaccttcagcacgccgccttcacggattttcccgtgggtccgaatgcgctcctccagcagtttcattatgtccctctccttactccacaagaaaaagttatttctattgtatcgaatttgacagacaactgcaactgcctatattctatcaaaaaagatcgctttcgtcacctgtttttagaaattttgtacggaggttctccccgctttccggtttttttattgtgcttttgcgccgggtttggtacaatgctgttgatcgcttttgagcaaggaggtttattgttatgaaacaccgtttctgtgcggcagccctggccgccgttttgcttttgagcgccgcacccctctcccccgcggccagcgccgcattttccgacgcggagggcacctgggccgcagaggtcatcgaaaaggcggagggctatggcctgatgaacggctaccccgacggcaccttcggcgtggggaaggagctgacccggggcgagtttgtggccgtgctctgccgcatgttcggctgggatgccgcctccccgggcgcgccctcgttttccgactgccccgcctctcactgggcctactcctatgtggagaccgccctggcccacggcgtgatggacgccggcggcgctttccgtccggaggactatatcagccgggaggagatggcggtcatgctggtgcgggccctgggctacggcacgctggcccagtccctgtccgggctggagctgccctttgacgacgtgacggacaaccgggggtacgtcgccatcgcctacgacatcggcatgatcaccggcgtggccggggcgggcggccagctcaagttcctgccccgcgactccgccacccgggaggaggccgccgccatgctggtgcgggtgtacgagcggtacacctccaagctggactggctccacggcttttacgccttctcctcctattcccagattgatctcaccgcctccatggacgcggtgagcgtaggctgggcccggatggagtacgaccccgccgccgggcccgtcctcaactcctcccgcaccaacggcaacgactgggtgcgccccgacgaccccacccccgccaccgattactgggatgcccgcagcctcccctacaacttaaatgtatatgcctcagcgggcgattccatccccctccccgacggcaccaccacctccacggtggcggcggtgaccggaacgcccgaggtccgggcccaggccgtggccgccctggcggccgccagcgcggactacgcgggcctgaccatcgactttgagggcctgaagggggataccataaaactgaattatgtaacctttctaaaagagctggatgccgtcctgccccaggggaaaaccctctatgtctgcgtccagcccgacacctggtacaccggctttgactaccggggcattggcgaggccgccgacaaggtgatcctcatggcccacgactaccagtggacctccgtccccgactcctatgtaggcactaccaacaccgactcccccgtcacccccttcgccagcgtgtacgaggctctgcgtgatcttaccgacccggccaccggcgtggccgaccggagcaagctggccctgcagatctcctttggctcggcgggcttccacgtggacggagaggaccgcctgctggagaccactatctaccaccccgccccctccaccctggctctgcgcctggcccagcccgacacccaggtggtctactcggaggaattccgcaatccctgcgccctctacactaccgaggacggcagccgttacaaggtctggtacgagaacgagcagagcgtgctggacaaggtggcgctggcccggatgttcggcatcacaggagtctccctgtggcgcatcggcaacattccggcggacggtgcctacgacgtgtggagcgctctgctgacccagcgctgacccgcttaccatctacttaggaagtgaaacggatgaccaaccgcaaggaactgctgcgcgaattcctgctgatgaacctgggcaccctgctggtgtcggtgggggtctactttttcaaatttcccaaccatttctccatgggcggcgtgtccggcctggcggtgctgctgggaaagctgctgccccagctctccccctctaccttcaacaccatcatcaatgtgctctttttggtgctgggctttgtaatgctcaacaggggcttcggcgcccggacggtctactgttccattctctccgccgggctcattcagctctttgagtgggcgtttcccatggaccgtcctctcaccgaccaactcatgctggagctgttcttcgcggtgatcctccccgccctgggctccgccatccttttcaacatagacgcctcctccggcggcaccgatatcgccgccatgattctcaaaaaatacaccggcctggacgtagggcgtgccctgctcctctccgacgtggtcatcgcggcggccgccctctttgtctttgacatcacggcgggactgtgctccctgctgggcctggccctcaagtcggtgctggtggatagcgccatcgagtccttcaaccggcgcaaggcctttttcgtcatctcctacgacccggagcatgtgtgcgactatattacccataccctgggccggggcgccaccgtatggcaggcccagggcgcttatacccacgcagagcaccacgtggtgctcaccgtcctcaccagggggcaggccgtgcttctgcgccgctacctgaaaaagattgatccccatgcttttctgattgtagccaactccagtgaaatctttggaaagggcttcttacagccctgattctccgcccgcccggacctaaatgccgggcgggcttttttgctgtgcaggagcagagcaaaattagccctgtgccgcttaacagcggcacggccatgggatgacagcgcgtgggtcggtacggcccacatacgcaaccacttcatgcgcctgagcctttgcgtcgtttcgcggtacgccctgtgcgcacgaagctttctgtcattttggaaaatatttcccaatcgacggcattcggctttttttgcgccaaaatatggtaatatatggttagtcaatattctaccgcaaaggaggctttccgatgtccttactgcgtcgaaaaggactgtttgagagcaccaaagtgctgtttctccccattgccgccatttcccccaatccggaccagccccgcacctgcttttcccgggagggcctggaggagctggccgccagcattcaggagcttggcgtactccagcctctgtccgtccgccggtccaagaacggcggctacgagctgatttccggggagcgccgcctgcgggcctcccgcatggccggtctcaccgaggtgccctgcattctggtcagcgtggacagccagggctcttctttgctggccctggtggagaaccttcagcggcgggatctcaactttgtggaggaggccaccgctctggccaagctgatcgagacctaccatctgtctcaggaggaggcggcccgccgcatcggcaagtcccagtcagcggtggccaacaagctgcgcctgctccgcctcccgcctgatgtcctcactctgctgcgggagcgcggctgcaccgagcgccacgcccgggcgctgctccgcctggaggagccggagctccagcgcatggccgcccggcatgtggcagagcaggggcttactgtggcccggacggaggagtatgtggaagccctgcttcatccggcagacaagcccgcccgcaaaaaaccaacctttgtaattaaggatgtgcggctgtttctcaacaccgtgactcggggactgtccatgatgaagagcgcgggcgtacaggccaactgcaagcgccaggagacggaggactccatcttgctgaccatcactattcccaagtagaggcgcgccgtacgcggaggccatggcggtttttctgaaaggatggggctgtttcacgtgaaacagctccatcctcttttttttcctgtttcacgtgaaacagtgcgaatttcagttgaattacgtctaccgccgctatataatagaacctgaccctttgcaacgacccaaaaaggcaggtgtgctatggcaaagaccattgcgattgtgaatcaaaagggcggcgtgggaaagactaccacctgtgtcaacctggcggcggctctaaaaaatcagggctgccgggtgctggtgtgcgattttgacccccaggccaacaccacttccggcttcggcgtagacaagaccacctcgcccaacatctatgacgtgcttctcaacgggacggagaccgctaaggccatctcctccacctcctacggcgatgtgctcccctccaacaaggcgctggcgggggccaccattgagatgatcgccctggagcagcgggagtaccggctgaaaaacgccttggagcaggtggcggaacactatgactacatcttcattgactgtcccccctccctggaactactgaccctcaacgccctgtgtgcagcggataccgtactggtaccggtgcaatgtgagtactacgccctggaggggctcagcgaccttctctccaccattcgcattgtcaagcgatccctcaaccccaaaattgccctggagggggtggtactcaccatgtacgacggccgtaccaatctctccatgcaggtggcggaggaggtcaaacgccacttccccggccaggtgtacgccacggtgatcccccgtaacgtccgcctgtccgaggcccccagctttggcaagccggtgtccgcctatgacgccctctcccggggcgcggaggcctacgatgccctggcccaggagctgctggagcacaatcaatacgccgtcacccgtgtggaaaggaaggattgacctatggcattggaacgcggcctgggcaggggcctgggcgcactgctgggggacgccgccctccagtcccaggaggggggctccctctccctccccatctcccaggtggaaccggggctcaagcagcctcgaaagcggtttgacgaggaaagccttcaggatttggccgactccatccgcatccacgggatcattcaacccctcaccgtccgccggctctcgtcgggctactaccagatcatcgccggggagcgccgctggcgggccgccaagctggcgggcctgaacgaaatccccgccgtcatcatcgaggccgacgaccgcaaggtgatggagctcggcctgatcgaaaacctccagcgggaggatctgaacccgattgaagaggccaacggctacaaggtgctcatgagcgaatacggtctcacccaggaggaggtggcccagcgggtgggcaagtcccgccccgccgtggccaacgccctgcggctgctggcccttcccgacccggtacacctgctgctggaggagggcaagctctccgccggccacgccagggccatcctggccgtgcccagcggggagctgcagaaaaagctggcgcagaaggtcatcgcggaggagctctccgtccggcagaccgaagccctggccaagcggctggccgcggaacccagagaagctgcggagcccaagtccgccgccggccctgacctgtccatctatctgcgggaggcggaaaagaccctggccacccgcttcggccgcaaggttcacatcatcaacggccggaaaaagggaaaaatcgagctggaatactacaatccagaggatttgaacactctgctggagctgctggagcagcttccctccgccgggaaaggagggggttccctttgagcaccgattccgacaagcaggagcgcagccgcctccagcacgaggcggagcatgagcggccccacaagcgcagctccgtgctgctctacctggtcatcctctttgcagcggcttttctcctgctgctgatgtcctacttcatgcagcagcgggccaaccaggaggccatggacaagctggagcagacctccgactcggctacccagtccctggagaacattctccaggaaaacgagaccctcaaggtggaaaacgaggccctgagccagcaggtggcccagctccaggaagcgctggaggacgcggaaagcgcctccgacggcgaggccgccctggtgcagctggaggcgctctgctatttgaaccaaattcgcgccctatacaacgacgggcgctactccgatgcccgggatgcggcggccgccgccgaggccgctctggctggagcgggcggcatggagggggtactgggtacggtggccgatgggctcaccggccagcagcgacaggactacaaccccctggaggcctaccagtccctcatggagtggctgggctgattgtttcacgtgaaacggcgtcgggacaaagtccgctccatttcatccggcgctgtgcgccggatatccattccactcccttgtccctccgcttccccacgcgacccgctccgctgggctcccgtgggggccccatctgcacaaagtccgctccatttcatccggcgctgtgcgccggatatccattccactcccttgtccctccgcttccccacgcgacccgctccgctgggctcccgtggggccccatctgcacaaagtccgctccattccatccggcgcacggcgccggatatccattgcactcccttgtccctccgcttccccacgcgacccgcttcgcacttttctctcccctataggggcggctttatggtcgcccgcgggcgactacaagggtcgcccctacgggtttatctcacaccactttattgaaggagaatcaaccatgctggacattaaatttatccgggaaaatcccgacgccgtgaaggagaacatcaagaagaaatttcaggaacagaagctccccctggtggatcaggtgctggagctggacgcagagaaccgccgtaccatccaggaggcccaggaactgcgcaccgcccgcaacgccaagagcaagcaggtgggcgtactgatggggcagtccaagaaagacccctccaagctggcggaggccgaggcgctgaaggccgaggtcaaggccgacgccgaccggctggccttcctggagggccgggagaccgagctggccgcggagatccgccgcatcctgctccagatccccaacatcatcgatccctccgtgcccatcggccccgacgactcctgcaacgtggaggtgcaacgcttcggcgaggcagcaacccccgcctttgaaatcccctaccacacccaaatcatggagtccttcgacggcatcgacatggacgccgccggccgggtatccggcgcgggcttctactacctgatgggcgacatcgcccgcctccacgaggcggtgctggcctacgcccgcgacttcatgatcgacaagggcttcaccttctgcatcccccccttcatgatccacggcaacgtggtggagggcgtcatgagccagaccgagatggacgccatgatgtataagattgagggagaggatctctacctcatcggcacctcagagcactccatgatcggcaagttcatcgaccagatcatccccgaagacaagctgccccagaccctcacctcctactccccctgcttccgcaaggagaagggcgcccacggcatcgaggagcggggcgtctaccgcatccaccagttcgagaagcaggagatggtggtggtgtgcaggcccgaggagtccatggactggtacgagaagatgtggcgctggtcggtggagctgttccgctctctggacatccccgtgcgccagttggagtgctgctccggcgatctggccgatctcaaggtcaagtcctgcgacatcgaggcgtggagcccccgccagcagaagtacttcgaggtgtgctcctgctccaacctgggcgacgcccaggcccgccgcctcaagatgcgggtcaagggggagaacggcacctacctgccccacaccctcaacaacaccgtggtggcccctccccgcatgctcatcgccttcctggagaacaacctccaggccgacggcagcgtgaagatccccgccgccctgcggccctatatgggcggcaaggaagtgctgacgcccaagcagtaagccgctctcccacgtattgaaaggagcgcctttgtcatgaagcaccgcttaccggccgccgctctcctgctcgccgccgccctgctgctgggcggctgtaccgccgggccccagcctgcggaatccgcccagccggaggagacgcttacccaggagcagattgacgctatctcagaaaagtacggcctggaatcccccaccccgcacacgccccccatggatatggactggggctggagtgtcaagaatccctaactggggctattctccccgttcttttgtcgcttatcgtttaaataaggagtttttatgtctgctaaagagaaaaccaccggctttttggccgaattccgcaaattcattgcccggggcaatgtgatggatctggccgtcggcgtcatcatcggcggcgcgttcaagggaatcaccgactccctggtaaacgacatcctcaacccggtgctcggcatcttcgccggggacaatgaggccctggctggcctgtctatccccctgcccggcggcggcgacctcatgctgggcagctttctcaacgccgtgctcagcttcctgattatggcgtttgtggtgttctgcatcgtcaagctgctgaaccgtctccacaaaaaggaggaggccgcccctcccccgccccccaagccatcggcggaggaggcgctcctcacggagattcgggatcttttaaaggagcgaaaaaatggctgaactaccagataataaaaatcaggaggagtcgtcctcctatacgcctgcctcccccgtcaagcggatcatcgcctgggtgggggtgacctacatgctcattttcgtgcttctcaacctctacccctttttccacggcggcgcctacctccaggggctggcccccctgctggtctgccccggtgccgccggtctggcggtgattgccgtctggcagttccgccggccggagtgcacctactccaaaaaagcctgcatggccctgctggcggcggcctgcggagtgatccttgtaatcggcctggtgcagggcgtgcccgccctgctggccggactgggggtgtgagcatgcaagcgcgtattgcctccggcctgaccgccctgggcctcacgcctcccgacggcgcagcggcccggctggctgagtacggccgtctgctgctggagcagaaccaggtcatgaacctcaccgccatcaccgagcccgaccaggtggccgacctgcactttctggactccgccgccctgctcaccctgggggaggacctccggggcaagcggctcatcgacgtgggcaccggcgcgggcttccccggcctgcccctgcgcatcctggagcccagccttcagctcaccctgctggacagcctgggcaagcgggtgaattggcttgcctcggtgtgcaataccctgggcctggagggggtggagtgcctccacgcccgggcggaggagcaggccctggtggacggctaccgggacggcttcgactacgccgtgtcccgggccgtggcctccctggagctcctgtgcgagctgtgtctgccctatctgaaggtgggcggcagatttctggccatgaagggcgtggacagcggcgaggagatcaaccacgccgcccggtgcatctccatcctcggcgggcggctgctgcccagtgtggactatgtcattcccggcgccaatgtgcgccaccgggtggtgctggtggagaagtgcacccccacccccaatggctacccccgccggtgggcaaagatacagaaagccccgctgtagcaggaattttctcactattctgcacaaaaacccattgattccactgtggaagtatgatatggtatttacgtcaaacaacgggagtgaacctatgtccactgcaattgtgatcacgtcgggaaagggcggcacgggaaagacctccattaccggcggtgtagcctcctgtctggccgcgctgggccaccgggtgctctgcatcgacatggatatcggcctgcgcaacctggacctgaccttgggtctgagcgaccgggcgctgatggacttcactgacgtgctctgcggccgctgcacactggagcgggccgccgtcccccaccccgtcatccaaggcctgttcctcctcaccgcccccgtcaccctgcccgaagcgccgctcagcgaggcggccatgaaggagctgattcaccgggccagggaggggtacgactacatcctgatggattcgccagcagggctgggcgaggggttccgtttggcctgctgtgcggcggaccgggccgtggtggtttccacgaccgacgcctccgccctgcgggacgcccagcgcacggtttcggtgctccggaaccgcatcccccgcatccatctggtggtcaaccgggtacagccccggctgctccgccgccttcacaccaccattgacgacgccatggacgccgccggcctgcccctgctgggcattgtgccggaggatccccaggtgatgctgtgcgccaaccagggccagcccctcattctccgggccagccggggcgccgccgtcgcctatctcaacattgccaagcgcctgcttggccagaaggccccccttatgaaaatgcgataagcgcaacacgctgtggaagagaggttagtacgatgaatattgccctgatgagccatgaccggaaaaaagagctgatggtgcagttctgcattgcctactgcggcattctctccaagcataccatctgcgccaccaacacgactggccgcctggtggccgaggccaccggcctgcctgtccagctcttcctctcccacgagcacggcggcagccagcagatcggcgcccgcatcgcctacaacgagatcgacatggtgcttttcttctcagacccccagtccaacgatctggacgcggatctgaagtatatcaccaccctctgcgaccagtacaacatccccttcgccaccaatgtggccacggcggagattctcatccacggcctggagcggggggacctggactggcgcgatatcatcaaccccaagaccaagccctttaccgcgtaactgggcggttcccggttgactttttccccgctttggggtagtattgtggagcaaaaaccgccctgacggggcaagtaccgcccacaccgccgcagcagagaaggacgcctccggctgaaagcgtccgcggcaggaggccgggagacggccttaccagcgggcccggagacgggtgtggtccccttcccgcaacagaaggacagagggagcggaattccgctctgaacatgggtggcaccacgaaagcaggcgctttcgtcccgtggcaggggacgagagcgcctttttacggcccaccccggcctctgagtccctccgccgcccggtaggggccgacgccccagggcggcctctcttgcccctctggggcaattcaccttctgcccacatcggcccggccagtgtggagacgagacgcaccctgtccggctttatggagctgctgacccgccgggagcccctctttttcatccaaacaggccgaagtgaattcggcctgttccaaggttttgctgcgcaaaacgcttgacgccgctttcgcggcgaggcgggcagcagcctcaattactgttaaaaaggagcatcactatggcccagatcaaaccccgcaccctgtccggttttatggagctgctgcccgcgcggcaggtacagttcgaccggatggtggagattctgcgcaagtcctattccctgtacggcttcacccccctggataccccggccatcgaggcggccgaggtgctgctggccaagggcggcggcgagacggagaagcagatctaccgcttcaccaagggcgactccgaccttgccctccgctttgatctcaccgtgcctctggccaagtatgtagccctgcaccagaatgagctgaccttccccttccgccggttccagatctccaaggtctaccggggagagcgggcccagaagggccgctaccgggagttctaccaggcggacatcgacgtcatcggcgacggcagcctgaacatcaccaacgaggcggagatcccctccatcatctacaagaccttcaccgccctgggcctgcgccgcttcaagatccgggtcaacaaccggaaggtgctcaacggcctgttcgccatcctgggcctggagaagcaggccggggacgtgatgcgcaccatcgacaagctggagaagatcggcccggagaaggtgcgcgccatcctgacggacgacttcgccgtacccggcggggcggccgacgccctgctcgccctcctggccgccggcgatcccatggccgcgctggagcccttcaaggggaagaacgagcttttcgatctaggcgtggccgagctggagaccgtgatcaggtatatgtccgccttcggcgtgccggaggagcacttcatggtggatctcaccattgcccgcggcctggactactacaccggcaccgtgtatgagaccgtcatgctggatcacccggaggtgggttccatctgctccgggggccgttatgataacttggcggaatattataccgataaacaactccccggagtcggtatttccatcggtctgacccgcctgttctccgtactggaggcccagggctatctgaacgacgccctggtcaccgccccggcggacgtgctgatcctccccatgaccgaggagctctcccccgccatctccttcgccaccgccctgcgggacgcgggcgtgcgcgcccagctccactgtgagaagaagaagttcaagcagaagctgtcctatgcggacaagctgtccatcccctacgccgccttcctgggggaggacgagattcagcagaacaaggtgacggtaaaggatctgaccaccgggcagcagcagaccgtgacggccggggaggccgtggccttggtacaggccgggctggcggcccgggcgggcggtactcccatccaggagccggaggcctgatggaactttctccccatgtccccgtctaaatggggaaaacccgacgtacaggaggaaatgttccatgaaaaagcagctcatcgccctggccctgtccaccgccctgctggcaggctcctccgccgccatcgcgccggaggaggccttccccgccgtcaacacctatcccggctttgccgatgtggccggttcggcctggtacgccgccactgtccagacctgctatgaggtgggcctcatgaccggcaccggcgccggctttgcccccgaccaggtgctcaccgtgggcgaggtggccgccatcgccgcccgcatgaacgaggccatcaccggcgactccatttacctggtggattccatcctgccctggtacacctcctatgtggactatctggagaagctgggggtggaggtgcccgatcccgtcaagcaggccacccgccaggagttcatcgccatgcttgccgccgtggtgcccgaggatatgctgacccccatcaaccagatcaccgccctgcccgacaccgccgacgccgccgtgctgtccttctacaacgccggcatcctcaccggcgtggacgactggggcacctttgcccccggcaagaccctcacccgggcggagaccgccgccatggtggcccgggtcgcccggccggagctgcgggagcgcttcacccccgccgactacgccatgttcaccgccgcctacctcaagcccgccgacgtgctcttcaccaacggcgtcaccgccgggcagtatctgccctatatccagaccctcatcgacggcctggaggccgactgcgccgcccagggcatggagttcaactggtttaacaccgtggacggtgtgaccttcctggactatgtggaggacaccgccctggcccacttcggcgtcaccgccaaggacggcacccagctctaccaggacttcgacatgcaggtgtattacagccgctatcaggatcagaagggataagctccgggcgggtgtgggcacccacccctacgatccccctatacaccccctctcccgtaggggcggcccttgtggccgcccgtgtctcccgtaaaggccgatgcccacatcggcccgctccgggcggggacaagccccgcccctacgatccctctatacgccccctctcccgtaggggcggccctcgtggccgcccgtgtcccacgcaggcgccgatgcccatatcggcccgcctccgggcggggacaagccccgctcctacgatctccctatacacccctctcccgtaggggcggccctcgtggccgcccgtctccctcgtaggggccgatgcccatcggcccgctccgggcggagacaagccccgcccctacacccctctatacgcccctctcccgtaggggcggcccccgtggccgcccgtgtctcccgtaaaggccgatgtccacattggcctgcctccgggcggggacaagccccgcccctacacccctctatacgcccctctcccgtaggggcggcccttgtggccgcccctgtcccacgtaggagccgatgcccacatcggcccgcccccgcgtccctttgggcgttccgatctgcctatatggctctcttttcgatcctatttgtattttatccttcttatattacaatttggagttgatttttgatgcagacaacccatacccattaccgcacccacacctgcggggatctccgtatggagcacgtgggccagaccgtcaccctggcgggctttctggagaacgtccgcgaggtgggccagaactttgccttcgccgtcctgcgggacttctacggggtgacccaggtggtcgtggagaacgaggccatgtggaaggccttcaaggggctgaacaaggagtccaccgtccagatcaccggtgtggtgcgggagcgggactccaagaaccccaagctgcccaccggcgacatcgaggtggtgccggaggcggtggaggtgctgggccgctgccgccacaacgagctgcccttccagatcaaccgcagccgggaggccgacgagtccgcccgcctgaagtaccgctatctggatctccgcaacccggaggtgaagaacaacatcatcctccgctgccaggtggtggccgccctgcggaaggccatgcttgaccacggcttcctggagatcaccacccccatcctcaccgcctcctccccggagggcgcccgggactatctggtgcccagccgcaagcaccccggcaagttctacgccctgccccaggccccccagcagttcaagcagctgctgatggcctccggcttcgacaagtacttccagatcgccccctgcttccgggacgaggacgcccggggcgaccgctcccccggcgagttctaccagctggacatggagatggcctttgccgatcaggaggacgtgttcgccgtgttggaggacgtgctgccccccatttttgcccagtacggcacctacaacgtggcctccaccgcccccttccgccgcatctcctaccgggatgcgatggacaagtacggctccgacaagccggatctgcgcattgatctgaccgtcaccgacgccactgaggccctgggcgcctgcggcttcggcccctttgaggggaacaccgtcaaggcggtggtggtcaccggcttcgagggcacccgcaagcagatcgacaagctgtgcgccgacgtggaggtccagtccggcgaaaaggcctactggttccgctacgacgagaacggcgagattgttggcggcatcgccaagtttgtccagcccatgaaggacgcggtggtggccgctctggggctggaaaagggctgcttcgtgggcctcacagccggcaagctcctggccgcccagaaggccgccggcgtgctccgctccaagctgggcgccttctgccccaaccacatggacaaggagtgctatgagttctgctggatcgtggacttccccatgtacgagatcggcgaggagtccgggcttttggagttctgccacaaccccttctccatgcccaacggcggactggagatcctgaaaaaggccgccgccggcgaggtggaccccctgtccatcaccgccttccagtacgatctggtgtgcaacggcgtggagctctcctccggcgccgtgcggaaccacgatccggagatcatgatcgaggccttccagctcgtccgcctgggcgaggacgacgtgaaggccaagttccccgccatgtacaacgccttcacctacggcgcgcccccccacgcgggcatcgcccccggcgtggaccgcatggtcatgctgctggccggcgaggactccatccgggagatcatccccttccccatgaacaagaacgcccaggatctcatgatgggcgccccttccttcgtcacccaagcccagctggacgagctgaacatcgtctgcaccaagaaggaggaggacgaggccgccgagtaaccgccttcgcaagttttccacaggatcctttccgcatgtggaaaaccggatcaaacaaaaaccaggagcacaccgctgtggtgtgctcctggttttgtatctcatagtatcctctttgtaggggcggcccttgtggccgcccgcgcttctcccgtaggggccgatgcccacaccagcccgcctgcgggcggggacaagccccgcccctacgcccccggcgaaacccttgtacggcgcaagcgccgccccaccctgtggggccccagaggtcaaaaagaagatgccgtcattcctcatccagcttaagaaccgccaccgcaacgttaagcaaacgtgccggtggcacgtttgtagcgtaggccgcagcggctacggcgcgaggagggaactttgcggatgcttactcttcgtccaatttaagcaccgccatgaatgcctcggtcggaatctgtaccgttcccaagctccgcatcttctttttgcccgccccgcgaaagccatgcctttcgcggggaccccctctccatttcacatgctcgggcggagtgaatccgccctgcgccaagggtttcgctctcggcgaaacccttgtacggcgcaagcgccgccccaccttgtggggccccagaggccaaaaagaagatgccgtcattcctcgtccaacttgagaaccgccaccgcagcgttaagcaaacgtgccggtggcacgtttgtagcgtaggccgcagcggctatgccgcgaggagggaactttgcggatgcttactcttcgtccaatttaagcaccgccatgaatgcctcggtcgggatctgcaccgtacccaagctccgcatcttctttttgccctctttctgcttctccagcagcttctttttccgggtgatgtcgccgccgtagcacttggccagcacgtccttgcgcatggcgcggacggtctcgcgggcgatgaccttgccgccgatggcggcctggacgggcacttcaaagagctggcgggggatgttgtccctcagcttttcacacagccgccgggcgcgggggtaggccttctcccggtgggcgatgaaggacagggcgtccacctgatcgccgttgagcagcatatccaccttcaccagctcggagggctcgtacttgtccagctcgtagtccagggaggcgtagcccttggtgcgggccttgagggtgtcgaaaaagtcgtagatgatctcgcccaggggcatggagtagtgcagctccaccaggttggtgtccagatactgcatgtccttgaactcgccccggcgctcctggcacatgggcatgatgttgcccacatagtcgggcggcgagacgatggacaccttggcgtagggctcctcagccagctcgatcaccgccgggtcagggtaattgtggggattgtccaccatgaccacggtgccgtcggtcttggtgatacggtagatcaccgagggcagggtggtgatgagatccagatcgaactcccgctccagccgctcctggatgatctccatgtggagcatgcccagaaagccgcagcggaagccgaagcccagggcggcggaggactcgggctcgaaggacagggaggcgtcgttgagctggagcttctccagggcgtcccgcagatctggatacttggagccgtcctcggtgtaaatgccgcagtacaccatggcgcgggcggggcggtagccgggcagggcctcggcggcggggcgctccacaccggtgacggtgtcacccacctgggtatccttcacgtttttgatggaggcagtgaagtagcccacctcgccggcgatcagctcgccgcagggctccatccccagggggagcaggtggccgcactccagcacctcataggacgcgcccgaggccatcatcttcaccttcatcccggtcttgatggtaccctccatcacacggaaatagacgatcacgccccggtaggcgtcgtactggctgtcaaagatcagggcgcggagcggggcctccgggtcgcccttgggggcggggacattctttacgatgtcctccagtaccgcgtcgatgttcagccccaccttggcggagatctcgggggcgtcctgggcgggcaggccgatgatgttctcaatctcgtccttcacccgcttggggtcggcggcaggcaggtcgatcttgttgatgacgggcagaatctccaggtcgtgctccagggccaggaaggtgttggccagggtctgggcctcgatgccctgggcggcgtccacgatgagcaccgcgccctcgcaggcggccagggagcggctcacctcatagttgaagtccacgtggcccggcgtatcgatcaggttcagctcataggtctccccgtcggcagcctgatagttgagcttcaccgcccgggccttgatggtaatgccccgctcccgctccaggtccatgttgtccagcagctggctctccatctcccgctgggaaacggcgttgcacttctcaatcagccggtcagacagggtggatttgccgtggtcgatgtgggcgataatggaaaagttgcggattttggattggtcagtcatggcatactcctcccttcggcaaatccacccggaaccccgcgcagcggggcgcggcggcctgccgcgtccaagcgttttgtcccccggacaaaaccttgccgaaggcggaatttacttccgccgaggatgcaaaataacacggggtacccgcggagtcggccgactccgcgggatttgatttgccgtggtcaatgtgggcaattatcgaaaaattacggattttgctctggtcggtcaaaaaaatacacctccgaagatgtgaaagcatcgattgacattggagcgatactctgcatatccctactgcggccgccccggccgttcaagggcatggtaccggtggcgccccccgggcgtacccggtaaacaggcggcgcgtccgggatgccgcgccctacttctggttctgaatctccatccggcggttgacccgctccccggtgttgtggataatctggagcagggactggtacagtccggggtagttctccatcagcgcgtcgttgtgcatgggcgggaagctccccttctccttgacgtgggcggccagggcgtccacatactgggcctcggtacagatcatgtcggcggtggccacgcccgccataaactgccgggcgggcacggagaagaagtcctcgttcttgctgccatccgcccggtacaggtggcgaaacatcttgtaaacagcggtacccaggtagtccgccgcggcgttaatggcctccttgcggccggtcttgcccagcaggtcgaagagcacgccgatggagttgaccagcagctttttgttcagcgtggccataatggagccgtggagcacgttgtccttctcggtggagtaatcgtacagctcttcggcggcgatggtggtgccgtcccgggagagggtacggcccagcaggaaatccgccgacacattataatagttgcaggccttcgtgacaaaggccagaccgggctcacgcacgccgttctcatagtgggagagcagcgcctggctgatccccagatcctttgcggccgcgcgctgggagatccccttctcctgccggagcagggaaaggcagcgggaaaaatcggaactcataacacacctcaacttcaactggcttcaaaacagtaggtatagtataaatgtgagaatacaaaaagtaaagtgtattttttcacaatcttatggcttttaggcattgagaaccgcagtcgaaatggtgtataatagctccgacgccgagcattttggcatttgacgtacgttttttatgatggaggaagataccaatggccattcacatgtttcagcagctcatcgacaccctgaaaaagtcccccaagcgcattgtctttaccgagggcaccgacgcccgcatcctggaggccagcgcccgcctgctggccggcacctggctggcccccatcctcatcggcaatgaggcggaggtaaaggccgcggccgaggaggtcggcttcaacatccggggtgccgagatcatcgaccccgccacctatcccgacatggacaagatggtggaggagatggtggcgctgcgccgcggcaagatgaccgccgacgagtgccgcgccgccctgatgaagggcaactacttcggcaccatgctggtaaagatgggcgtggccgactgtctgctgggcggcgccacctactccaccgccgacaccgtccgccccgccctgcagctcatcaagaccaagcccgagaataaaatcgtctcctcctgcttcattatggtccgcgagggcgtgggcgacaacactgtgctggccatgggcgactgcgccatcaacatcgaccccacggaggacgagctggtggagatcggcctggagtgcgccaagtgcgccaaaaccttcggcattgaccccaaggtggcctacctgagctactccaccaagggctccggcaagggtgacactgtggacaagatgcgcaacgcctgcgccaaggccaaggctgccgcccccgacctggccatcgacggcgagatgcagttcgacgccgccgtctcccccaccgtgggccagctcaagttccccggctctcccgtggccggctatgccaacacctttattttccccaacattaatgcgggcaacattggttataagattgcccagcgcctgggcggctttgacgcctatggacccattctgctgggtctgaacgccccgatcaacgacctctcccgcggctgcaacgcccaggaggtctactccatggccatcatcaccgccgcgctggcctaacagccctccaaagtccggagtttccttcaggggctccggactttttccggccatggaggagacctccgcccactccgggggcacggcgctccgcgccgtcaagcgttttgcgcaagggcgcaaaaccttgatgccggggcaatttacttgccccgcgcagtaaaaaagccgggggccccacaggcacctgcctgtggggggctgctccatggccatcatcaccgccgcgctggcctaacaaccctccaaagtccggagtttccttcagggactccggactttttccggctatggggggagatcccccgtcccctccggtcccccgcggcaccaaaaaggatgccgtgggggcttttcgtcccggtcaaagtggacaaatctttttgctgctctgccctgaccatttctccttctggtagtagtaggacatctttttgaaagccgcccactatatgtcgtgtcggttgtgctttgaccttcaattgccgcggattcccgccttttccagtcaaagtcttgactttttggcaaaaagcgtgtatgatacgccttgtaaccatttgtaacttttcgtttctgactgttacctttcggccctcgcgggccttcttttacgcaagaacaaataattaggagggtttccctcatggacgaaattctgcatacgccccgggaggagtcttcggccatccggccgcccctggcccaactccgggacagatgggaggcgggtaccgcggccctggcgcagcgcgtggagccgctccgccgccggctggacgccgccactgcgggcggccgccggctgatcaatcccctgcatttcctggccgccgccgtggtcatcggcgtggcggctgtcgtgggcactgtctacactcccagctatgtggtggaggtggacggcgtggccctgggcaccgtcaccagcccctctgtgtttgaggatgtggtggaccgggtggagagccgtgccaccgatattctgggctacgactataccatggacggcgcggtgacctacgcccctgccctgacggagcgggagtccatcacccccgtggcggactttgagacctacctctttgaccagattggcgaggtaatgaagagctatgtgctcaccgtcaacggccagttcatcggcgcggcccaggatcgggagaccctgaatggggtgctggagcaggtgaaggctgcctatgtagatgaaaacacagtgtccgccgagtttacctccggggtctacattacccacgagtacaccccctccgatgtcaatcaggacccggcggccatgctggccaccctcaccgccaacaccaacggccagaccacctatgaggtgcagaagggcgacaccttcatgcagatcgcctttgacaacgacatgagcatgtcggaactggaggccctcaacccggatgtggacattaaccgtatctacatcggccagctcctcaacgtgaaggaggagattcccttcctctccgtcaagacggtggataacgtgacctataccgagtccattgagtgcccggtggtggaggtgcaggacgactccatgtaccagggcgagtccaaggtgctggatgcaggcgtccccggcgagcagatcgtcaacgcggacatcgcttacctcaacggcgtggagcaggagcgcacggtgctctctacccaggtcacccgggaggccaccaacaaggtcatcgctgtgggcaccaaggtgcgcccctcctggctgcccaacggctactttatctggcccgtatacgggcgcattacctcctacttcggctaccgctccatctttggctcctacagctaccacggcggcattgacattgccacctcctacggcaccaacatcgcggccgccgatggcggcaccgtggtcttcgccggccgggccaccggcagcatgtggagctacggcaatctggtcatcgtggatcacggcaacgggaagcagacctactacggccactgctccagcgtcctggtttccgccggcgacaaggtctaccagggtcagcccatcgccaaggtgggctccacgggccgctccaccggcaaccactgccatttcgaggtgaagatcaacggcacctccgtcaaccccctgtcctatctgagctgaaaaagaccggcgcaccctgacgggtgcgccggttttttcggctcagcggagcttcaggatttcatccagcagacggtgggcggcctcctccttggtgaggaggggcagctccagctcctcccggggggagatcagcgtgagcagattggttggcactgcgaagcccgcgcccggctccttgaggttgttggcggcaatcagatccaggtgcttcttctccagcttcctgcgggagttttccaccatgtcccgggtctccatggaaaacccgcacaggaactgccccggccggcggtgctcccccagccaggccaggatatcccgggtgcgctccaggggaatggacagctccccctcccccttcttcaccttgtcctgggccacctgggccgggcggtagtcggccaccgcggcggccttgatgatgatgtcctgctccggggcgcgggcggtgaccgcctcgaacatgtcctgggcggacaccacgtccaccgtctccacataggcgggcttcttcagcgccgtggggccggacaccagcgtcacctccgccccgcgggcggcggcggcccgggccacggcgtagcccatccgcccggtggagtggttggtcaggcagcgcaccggatccagtgcctcctgggtggggccggcggtgaccagcaccttcagtccctccatgtccttggcatgggagagggcgtgaagcaccgtctccagcagctcctccggctccggcatcttccccttccccacggccccgcaggccaggcgtccgctggccggctccacaatctcccagccgtaccgccgcaggagggccaggttatcctgggtaaccggattctcatacatgcgggtgttcatggcgggcgcggcgattttgggacagtcacaggccagaacggtggtggtgagcatatcgtcggccaggccatgggcaagcttagccagaacgttggccgtggccggggccaccagtaccaggtcggcctggtcggccagggcgatgtgctccacctggaactggtagttgcggtcaaaggtgtccacgcttacccggttgcccgtcagggattcaaaggtgtgggggccgataaactccgtggcgtttcgggtcatgagtacctggacgttcgccccctgcttcaccagggccgaggccaagcccgccgacttatagcatgcaatgccgccggtgacacccagcagcacagttttcccctttaacatgcaggtctctcctttgtcagtgggcggatgcggacatccgcccttatgctccgtatatagtcatccaattataccaaaacagccgcaggttttccacaatgggattgcaatctgaggatataaccgttataatggcctcggctgtcccgggcggcgggccgctgtactccccggagggagacggcaggcccatctctgcctgtggctgcatccaaatacgcgctgtatcccgcccgtcgggaacggcagcctggaggtaattgaatatgaacacccacaccccccgcgcccagcagcaccggcaggtgcagagcctggctgtcctggccatgtttaccgccattctctttctgctcaccttcacccccatcggcatgatcgacctgcccatcattaaggccaccgtgctccatgtgccagtcatcatcggcgccctccttctcggacccaagaagggagcctttctgggcggcatgtttggtctggccagtcttttgaaaaataccctggtacccaacctgtcctcctttgccttttcccccctgataccggtaccaggcctggaccggggcagcccctgggccctggtggtttgttttgtgccccgtatccttgtcggcgtgaccccctggctggtctatacgctgcttcaggccctgtcccgccgccggggctccgtcctccaggccggcagcatggccctgtccgccgtggtgggcgcctttaccaacaccgccctggtaatgggactgattgctctgctgttccgggatgcctacgccgcggcccaggggattccagccgaggcagtgctgggctttattctgggcatcgtggcggccaacggtgtgcccgaggccattgtggcggccatccttgtccccgcagtgtgcatccccatgggaaaggctctcaagctcaaccgcgctcccctggccgcccgggagcccgtctgagccatgctgctgaccattgacattggaaacactacagtcgctgttggcggctttctggggccggagctgcgctttgtccgccgcctgcccagcgaccggaacatggacgccgccgcctgcgccgcgcgcatgagaaccctgctggcagaggagggagcggccccccaagacgtggagggagcggtgctctcttcggtggttccctccctcacccaggtcgccgtccaggcggcggaggccctcacccgccgccctgtccgggtgctggggcgggatctcgaccccggcctgcccaccggagactatgacgcctccaacctgggcatggaccggctggtggactgcgtggccgccctggcccggtggcggccccctctggcggtctttgacatgggcaccgccaccaccctgtcggtggtggatcgggagggcgtattccggggcggcatgattctcccggggctgcgcctgtcggtggacgccctcagcgcccgggctgcccaactcccttgcattacttttacccagcccgagggactgctgggtaccgatactgtgtcctgcatgcgcagcggtgccctctacggggccgccgccgccctggaggggatctccctccgcctggaggaggagctgggccccgtcaccgtagtccttaccggcggtcatggccgtgacattctacccctgctccgccgggcggtggagtatgagccccatcttcaattgatgggtctgcgggagctgtggctccgcagcctgtgaaaaaaggcggcgtaccggatcggtacgccgccttttttcagcccggccgctcacctgtgacccgccgctttttgtggcggtaccacacgcagttaaagacatttcccagaatcaggatgtttccacacaggtagagccacaccagcaggataatcaccgaggccagggacccgtaaaccagggagtacctggaagacaggccgataaaccaagaaaacagggcggtggcggccacaagggccacggcggccagaaaggcccctgtaaggataggcggccttggcctgcctcggggcgcggccatccggtacaccagcaggacaaagaggaacaccagcagaaacagcagcaggaagcggaaccactgccagtcccagggcagggtggccgtctccaggtgaaacaggcgctccaccagatggaaaagccacccgcctgtgaggagcaccaccagggccaggtagatggtgagcagaaagagcaccgaaaaggccacgctggccgcgatgcgccacacccctgcatagctcttgcgtccgtaaagatcctccataatattcatcagcgcccggaaggcggcggaggcggagaacagggtcataatccctcccgcggccagcagggcgggtgactggtttccggtaatatactgaatatagtcccctaaaatccccagcgtctcccggggcaggaaggtggaggcggcctccagtacggcgttgatgtccaaatggagcagaccgatgaaggcgttaatgcagataaggacaggaaagaaggtgagaatcagaaagtaggccagctccgcagccgaacgggatacccgcttggagaagtaaagctcccctacctccagcccaaaccggaccggcttccactccagcagctttttcatccttccccgcctcccccgcgtctcttttccagcatacccgttttctcccgcgaaaaagcgaaaaagaccgcctgcggatgcagacggtctccccttcgaccagacctttaggccagcttattcagcttaatggtcatggcgctcttcttgtgagcggcgttgttcttgtgcagcagacccttgaccacagccttgtcgaccgccttgacggccaccttgtaagcgccctcggcctcgctgcggttgccttcgaccaccgcggcctcgaacttcttgatgtcggtcttcagcgcggacttagcggccttgttctgcgcagccttggtcttgttcaccaggacacgcttcttggcagacttaatattcggcaaaccaaacacctcctccgatgacgtaatcgttatttacacagtttgcccgtgcagattcttattttaacagccattctttaaaaatgcaactctttttttgaacttttttcactttttttgcatatggaggcgctctgcgcaaaaaataggggcatctggtgtcatcaacaccacatcttggggtatggagggacgtatatgttgaaacggagaaccgacctggctctggaggccgcccagctctggcaggagagcgccggggaggccgggacgctgccgggcgtggagtcggaggagtcgacgcgggagggctatccggtgaccaccgtgcgcatccgggacgaggcgggcgcccgggccctgggcaagccggtgggcacctatgtgaccctggagctggacggcctggcccgccgggaggaggacgccttcggccgggcggcgcgggccctggcggcggagctgggggcgctgctgggcctggcgccgggcgcgcccgccctggtggtgggcctgggcaaccgggccatcacccccgacaacatcggccccaaggctgccgaccagaccatggtgacccgccacctggtggaacgggtgccggagcacttcggctccttccggccggtggccgccctggccgccggggtactgggcaccaccggcatggagagcggcgagcttgtccgcgccgtggccgaaaccctccgccccgcctgcgtcatcgccgtggacgccctggcctcccgcagcctccggcgggtctgccgcaccatccaactggccgacaccggcatcacccccggctccggcgtgggcaatgcccgggccgccctcaacgccgagaccctgggcgtccccgtcatcgccgtcggcgtccccaccgtagtggacgccgccaccctcacctgcgacgtgctggccgaggcgggcaagggggagctgaaccccgccgccctccagggcgcgggggacggcctgatcgtcacccccaaggacatcgacacccaggtgcacgatctggcgaaggtcatcggatacgggatcaatctggcccttcacaccggcctgaccatcggggacgtggagctctttctcagctaacccgggtcggccgccccgtccgacacctcgatccgaaacacattgatggtgtccacatcggggcagcagaacaccgccgtgcccgccggctggccggggatggcaccgccatagcggagaatatccacatagggaaaggccacatgcatggccatgggacagagcttcccccgctccgtgtcaaagtcaaagctctcccccacccggtgtccccggtggcagccccgctttcccagccggtcaatgagggtgatgcgaatcgccggacgcgccatggacaacagcctccttctgttttttatccacatcatagcacacaatgtggattttgtctcccccgcttcttgatcttttcccccggcgggcatacactctgagcagagaggagtgctgcccatggacgcctgcctggactatctgcgggagaacggggccgagccggccctggtgatcgacccacacacggtggtcaccgccccctggaccaccttcaagtgccagttcggctgtgagaatttcggcaaaaaccactgctgcccgccggaggccccggactacgcccgcacccgggccgtgctggacagcttttccaccggcatcctgttccgggtccaccactggaacgccaccgccatggccgccgagggggccaggcggctctttctggacgggtactacaaggccctggccttcggcagcgggccctgcaagctgtgtccctcctgcgcgcccgaggggtgccgcttccccgggaaggccgtccccgccatggaggcctgcggcatcgacgtgtttgccaccgcccgcgcccacggcctggaggtgcgcacgctccgggtgttgggggaggaacggaaccatttcggcctgattctggtggaataggccccgaaacgccttgacggcgggcggtttgcgtgatacaatagcggccagaaacaggcattgaccgggaggagtaccccgtcccaccgtcccaagagaggagccgtctggtgcaaggctccggcggaggcaggggaaggcgcccgccagccgcggggaggaaatgccccgccggtcccccgccgttaccgggtttgagcgcggggcctctgccccgaattcaggtggcaccacggagtttacttcgccctgagccgttcggctcagggcgtttttttccgcgcagaataaagcgaaaaggagcttatggatatgaagaacaccgaaaagaccatggatcagatcgtggcactgtgcaagggccggggcttcgtctaccccggcagcgagatctacggcggcctggccaactcctgggactacggccccctgggcgtggagctgaaaaacaacgtcaagcgggcctggtggaagaagtttgtccaggaaaacccctacaacgtgggcctggacgccgccatcctcatgaaccccgaggtgtgggtggcctccggccatgtgtccaccttcaacgatcccctcatcgactgcaaggcctgcaagatgcgccaccgggccgacaagctcatcgagggctggtgcgccgagaatggccgcgacgacgtgaatgtggaggccatgaccaacgaggagctggtggccttcatccgggacaacggcgtgacctgccccggctgcggcaaggcggacttcaccgacatccgcaagttcaacctcatgttcaagacccaccagggcgtcaccgaggacagcagcaccgaggtctacctgcgccccgagaccgcccagggcatcttcgtcaacttccccgccatccagcgcaccacccgcaagaagctgcctttcggagtgtgccaggtgggcaagtccttccgcaacgagatcacccccggcaacttcatcttccgcatccgggagtttgagcagatggagctggagttcttctgccagccgggcaccgatctggagtggttccagtactggcgggagttctgccgcaagtggctggtggatctgggcctgaaggaggagaacctccgcctgcgcgaccacgagcccgaagagctggccttctactccaaggccaccaccgacttcgagttcatgttccccttcggctggggcgagctgtggggcgtggccgaccgcaccgactacgacctcaagcagcaccaggagcactccggcaaggatctcacctacttcgaccaggagaagaacgagcactatatcccctatgtcatcgagccctccctgggcgccgaccgcgtgaccctggccttcctggtggacgcctacgacgaggagatcgtcggccaggacaagaagggcaacaacgacgtgcgcaccgtcctgcgcctccaccccgccctggcccccttcaagtgcgccgtgctccccctcagcaagaaggaggtcctctccggccccgcccagcagctgcgggacgagctggcccgcgacttcatggtggactatgacgacaccggctccatcggcaagcgctaccgccgccaggacgagatcggcacccccttctgcatcaccctggacttccagaccgtgggcgacgacaccacccccgcggatcactgcgtcaccatccgggagcgcgactccatggagcaggtgcgcatccccatgagcgaggtcaagaattatatcgcagagcgcatcaagttctgagttgtttgccaaaggcggcccatttgggccgcctttccttttccttccccgcgcccgaaatatgtggacatacagggacggatgtccgctgctccccccgttcaacgcttacacgtaggggtggggcttgtccccgcccgcctctttcgttcccgccccaggctccggccagccgggcggccacaagggccgcccctacagagaacggctggttgccgctgctcccccgtttcaacgttcacacgtaggggcgggtgcccacacccgcccgcctctttcgttcccgtcccaggctccggccagccgggcggccacaagggccgcccctacagagaacggctggttgccgctgctcccccgtttcaacgctcacacgtaggggcgggtgcccacacccgcccgcctctttcattcccgtcccaggctccggccagccgggcggccacaagggccgcccctacaaagcgcggctgctttccgctgctcccctcgttcaatgctcacgcgtaggggcggggcttgtccccgcccacctctttcctccccgccccagactcccgccgtccgggcggccataagggccgcccctacagagaacggctggttgccgctgctcccccgttcaacgctcacacgtaggggcgggtgcccacacccgcccacctcttttgttcccgcctcaggcttcggacaggcggctacgaggtccgctcccacttgtgtccccgcccggattctgctatactcaaaccaacttttccacactggaggcgttttttgtgggatccacccccctgtacgacgctctgcgggcctttgccgcccagcggcccctgcggatgcacatgcccggccacaagggtaaatccctgcctgcgccggagctggcggccattgcggccattgacttcaccgagctgccccccacgggggatctcttctccgggggcggggccatcggggcggcggaggccctctgggcgaaggttttccacatggcctcctgcctgtttctcaccggcggctccacccagggggtccacgccgccctggccctggcctgcaaaccgggggagacggtgctgctggaccgggggagccaccgctccgcctacaacgccctggccctgctggatctgaagccggtctatctggagcggccttggcttgcctcggaggggatcaccggccccatctccccctcgtcggtggcccaggccctagaggaacacccggaggcaaagacgctctgtataacctcgcccacttactacggagtgttgtcagatcttcccgccctggcggagctaatgcaccggcggggcggggtgctggtggtggacggagcccacggggcccatctgccgttcctgggaaatgaccacctctccgccgccgatctggtggtgacatcggcccacaagaccctccccgccctggggcagagcgccctgctgttggccggggaacggtttccccatgccgggctgcggcgggccgcctccctctacggctcctccagcccctcctatcccatgatggcctgcctggatctctgccgggcgtggatggaggaggagggcgccgccgcctaccgggccgccgcccggcaggtggccgccctgcggcgggactaccccagcgtgtccggcccggcgctggaccctgcccggctggtgctccgcgcccccgacggctttgccgcccaggcggccctggaggggatgggggtgtggcccgagatggccgacgcgggccatgtggtgttcatccccacctgcgccgacacggaggaggactttgcccgcctccgggccgccctggatgccgtggcctggggggacggcgctcccctgcccccgcctccgcccccgccggaggcggttctcaccccccgtcaggccctcttttccccccggatttccctccccctgtccgccgcggagggacgcatctgcgcccagcaggtggccccctatccccccggggtacctgttttcgcgcctggggagcgaatttgcaaaaaaactatcgcttatttgaaacaaataggttataatacactggaagacgttgaggttgtttccgaacctgtgtgtgcctcatagaatgagcaaaggagcgtctttccttcaggagggaaaagcaatgaaactgattcttgcgattatcaatcacgatgacgccaacaccgtcacccaggccctgaccaagaagggcttctcctccaccaagctggccaccaccggcggctttctgatggcgggcaacgtgaccattctcatcggcgtggacgaggagaaggtgcagaccgtcatcgacatcatccgggagcattcccacagccgcaagcaaatgatccccaccaccaccgagatgagctacggctactacccctccatgcccgtggaggtcgtggtgggcggcgccaccatcttcgtggtggatatcgagcggtttgagcgggtctgagtctttatgaacctgacccggctggcgggcaacgccccgctgaagcggcagctggagctggagacggcccggcggggcctctcccacgcgtacatcctcagcggcccggcgggctccggcaagcggaccctggcgggcctgctggccgccgccctggtgtgcgaccgccggggcggcgctttgccctgcctgtcctgcgccggctgccgcaaggcggaggggggcatccaccccgacatcgtgcgggtgggggacgacgggaaggatatcagcgtggcccaggtgcgcgccctccgcgccgacgcctacatccggcccaacgaggccgaacgcaaggtctacatcctggagaacgcccagaccatgaacgccagcgcccagaacgccatgctcaagcttctggaggagggcccggcctacgccgcctttctcctgctcaccgataacgccgccgccctgctgcccacagtgcgctcccggtgtgagcatctccccctctcccccgtcacccagcgggaggcggagctctggctggacgagcactaccccgaccagccccaggcggcccggcaggccgccgccgaccgctgcgagggcctgcttggccgggcagccgccgagctggagggacaggccgcaggcgacacccaggccctggacggcgcgctggagctggtgcgccgcctggacggcggtgacgagctggccctgctggagcactgcgtggccctggagaagtgggaccgggagcagctgcgcgccctgctggacgagggcgttctcctgctgcgggatgccctcgtctgctccgccggaaccctgcgggagtccgacccccgccggcgtgaggcggcggagcgcgccgcccgcgccctctccccccggcagctcacccaggcggtgggcgtgctggagcggctgcgcgccgcctgcggctccaatgtgggggccgggcacctggccggctggctgggggcggcactgagcaccctatgaccgggcgggcccgaccccgcccatacacctgatgcggaggtaatcatgaccgaaatcatcggcgtccgcttcaaaagcggaggcaaacagtattattttgaccccaatggacaggccgtggcccccggtcagggggtcattatcgagacctcccgcggcctggagtacggcgagtgtacccagggcaacaccatggtggaggacgaggcggtggtacagccgctgcgccccctggtccgcctggccaccgagaaggatctggacaccgtggcgaagaaccgtgagaaggaagcgcgggccttttccatctgccaggagaagatcgccgcccatggcctggatatgaagctggtggaagtggagtacaactttgaggggaacaagatcctctttttcttcacctccgaggggcgggtggacttccgcgctctggtcaaggatctggctggggtattccacgcccgcattgagctgcggcagatcggcgtccgggacgaggccaaaatgctgggcggcctgggcatctgcggcaagcccttctgctgcgccaccttcctggacgagtttcagccggtgtccatcaagatggccaaaacccagaacctgtccctcaaccccaccaagatttcgggcacctgcggacggctcatgtgctgcctgaaatacgagcaggaggcctatgaggacgcggtgcgccgcatgcccaagaacgagtcctttgtggagaccccggagggggtgggcaccgtatctcaggtcaacctgctcaaggagaccgtgaaggtacggctggaggagcagcccgaggcccccaagtgtttccacaactgcgagatctgcgtggtgcgcaacggcaaggggaagctgcccgagggctatgtgccccctcccccggaagagctggccaagctgcgcaagatcacccctgtggaggagccccaccgcctgtccggcagtgtggacgccgccctcagcggcctgggcgtcgcccccgccgagccggagaagcccgccgagggaggggagcgccgctcccgcggccggggccgccggggccggggcgggagcaggccgtccgccgagtccgccgccaaaaagcccgccgaggagggcaggcaggctcagccccccaggcagaagcaaaagggggagcagcagcgtccgcctcggccggaaaagcagcccaaggcgcccgccgcaccatccccggcctccgatgggacagcggcccttcccaccggtgagaaaaagcgcccccaccgccgccgctaccggggcaagcccaagggcgacaggccccagggcccgaaaccggaatcctgaccggcatgagacgggcgggcgctgtatgcgcccgcccgtttgtttgaggtgatttgctatgacggaatatcagaaaatgctgggcggccagctctacaacgcccaggacggcgagctccaggccatgcaccggacggccatggagctctgccacgccctcaaccagctcaaccccaatcagaaggaggaggcccgcgccctgctgcggcagcttctgggccggaccggcgaacacttcaccatcaaatccaccttctggtgcgactacggccggcacatcaccatcggcgagaacttcttctgcaactacaactgcgtgatgctggactgcgcccccatcaccttcggcgacaacgtcatggtggcccccaactgcggcttctacaccgccgcccaccccctggaccacaccctccgggacgaggagctggagtacgccaagcccatcaccgtgggggacagcgtttggatcggcgggggcgtcaccgttctgcccggcgtcaccatcggcagccgcgccgtcatcggcgggggcagcgtggtggtccatgacattcccgagggggttgtggccgtcggcaacccctgccgtcccatccgcaccctttaaatgcaaaaaaggagctccgccttggggcccataccgtaaggaagttaacacccgccaaaagaagttgcttttcggcgggtgttgccttatattaatttcaccgacaacgcggagttaggagagatacaatggatagaccggtcacaacgctatttatgcttatgtctgttgacggaaaaatcagcacaggggcaacagataatttagatttagacagagatctccccaaaattgcgggcgttcaagaaggactgcaccagtattatgagatagagcagacaaccgatctgtggtcgctcaattctgggagagtacaggaaaagctaggcgtcaactccaaggaaatgccgaacaagttgcctgtttcctttgtaatgatcgacaaccatcatttgaccaaacaaggtattcgctatttttgcgcccgctcaaaagaatttgtgctggtcacctccaacgcagaccatccagcgtttcagatggatgaggacaaccttcatatcatctgtcagagcaagttgtctttacctgacgcgcttgcacaactcaagtcagaatatggctgtcaaaggatcaccatacaaagcggcggtacattgaacgggctgtttcttcgggaaaaactgtttgattatattgatattgtgatcgcccctattttagtcggcggcaaggatacatccacactgatcgacgggaggtctttgctgtcagaaagtgaattatcccaattaggcgtgctgaaattgcaggaatgtatggtcttggaaaactcgtatctcagattgcgttaccaggtgatccattgacagcttccagtttactgttctttcccacgagtactttccccgaaagtgtcatagtgggttacatactataaaaagggcaagacagaccgtaatggtttgtcttgcccttaacttctttataaagccatgcccttatggcggagctcttttttatttggccagcatagcggctgcaaaggcccgcgcatccgccaggtccgtcccgtcggggtgggacagggcctggtcataggcccggagcatgttctccagccgggcgtcgccgggcttctccttgagctgagcctcataccgagcccggacggcagggggcatccgccccggacagaaccaggtacccaacacctgattttcctccggcacctccgcccggaaccggtcggagagagaggcaaaatacatctcagacaggccaaaacccgccgtgccgaacagggccacccgcttcccgtggagtccctgcaaaaactcctttaccgccggggcacaggtgcccttgtccgtccaggagcccacaaagatcagctccgcctcccccacgtcccggggcagcgggccgaaggccacaatctcatggccctgacatccctcgcggatggcctgggcaatctgggcggtgttgcccgtctcgctggcgtatacaatggcaattttcatcatgtcctcctctgaaaaacggcgggcggccacaagggccgtccctgcggtggcaataacgcaatacgctgtccggcgggattgatccccaactggcggaagccccgctttatttgctatgcaaaagcatcgcagaattggccatacgcccgcttacagcggcacggccatgggatgacagcgcgtaggccggtacggcccacatgcacaaacacttcatgcgcctgagcctttgcaccgtttcgtggcgcgccctgtgcacatgaagtgttatgtacggcgcaagcgccgccccgctagagcggggccccaagggcttatttatattttctgctctccgcaaccgccagctcgtcacagcggttattatggggattatccgcgtggcccttgacccagtggagacggacggtgtggcgctcgcacagcgcgagaagccgctcccacaggtcagggttgagggccggcttcttgtccgacttgatccacccacgggccctccagcccttggcccagcccttctgcagggcgtcaatgacgtacttggaatcggagtagagctccacctcacagggctccttcagcgcctccaaggcagtgatgacgccagtaagctccatccggttgttggtggtgtggggctccccgccggagagctccttgcggaactccccgtattgcaggatggccccccaccccccggggcccggattgcccgaacacgccccgtcggtatagatcgtgactgttttcataaatctcctatggccttcccctgggggaaggtgtcccgcagggccggatgaggggagcgccgccctgacctgccggtcaatggcagcgcacacaccttcaaaattttgtttgatttccaggttggtaaagcgcaggactcttattttttcaacctcttgcaaataggctgtccgaatcttatcctgctccggaccattcccctcataatgctgggagccgtccaattcaatggctaatttcgctttatggcaataaaaatctacaatataggggccaaatggtttttgccggagaaattggaccggataagtccgcaaaaaatcataccacaaatgattttcctcttttgtggcgtttttgcgcagttcctgggcacgggtaaggggcttttccttctgttccatattcgtactattcccctcatccgccccagtgtgcgcactggggcaccttcccccaggggaaggccctattgatccaccttgggatgctcctccggccactgacagcggaagtaaaggcccttttcgtgaaagacgctgtacacccccaccacggccgcggcggccaaaaccagaagccagaccacacccacgatacccaggtagaagaaatccctctgccccaggaagaacacgatcaggcgtaccgcggcggcggccagccctccgcccagaacacggctcaagatgatcctcaccctgccgggggcgcgggccatctgcacatatctcatgctctgctcctccctgccgttcaggggtcatccgggaactgccggcgcttttccccctgcggcccgtgcttacgcctgttccgggccgccggcgggagtctccccttcagcggcctcctcttcctcctcgtggtcggtacgggcgaaggagatcaccttgaccccctcctccaaattcataatcttgacgccctgcgcggtgcggccgtaggtggagatgccggcggccgccatgcggatgatcacgccggcgtcgttgatcaccagcacgtcgtccccgtcgctgaccaccttgacccccaccactggaccggttttctcggtgatattatagcccttcagtccaaatccgccccgcttctgaggcccgtcggcgcggatatactcgtccatgtcggtgcgcttgccgtagccgttttcggtgatcatcagcacctggtggtcccgcttggcccgggcggcccccaccacgtagtcgccggggcgcaggttgatgccccggacaccggcggcgtcacggcccatgcagcgcacgtcggtctccttgaagcagatggccatgccgtcgtgggtgacgatcaggatggcctggtcgccgtcggtctcccgcacgcagatgagctcatccccctcgtccagggtgatgcagcggatgcccgccttgcgggcggtgtagatggaggagagctggatgcgcttgacggtgccgctgcgggtgaccatcaccagatagcggtcctcggggaattcccgcaggtggatcatggcggtgaccttttcatcctgctcgatgggcagcacattgaccaggttggtgccccgggcggtgcggcccgcctcggggatctgatagcccttcttgcggtggaccctgcccttgttggtgaaaaagagaatgaaatcgtgggtggaggcggtgaacacggtgtccacatagtcctcctccttggtggacatggcggtaatgcccttgccgccccggcgctgggccttgtaggtggaggcggcggtgcgcttgatgtagccgccggcggtgagggtgaagacgcactcctcctcctcgatgagatcctcgatgtcgatctcgtcctccacgtcctggatctcggtcacccggtcgtcaccgtacctgtcccggatggcggtgagctcgtccttgagcacgccgcggatcttctcctcactggagagcagctcattgaagtaggcgatgcgcgcctccagctccttgtattcgttctgcagcttctccttctccagcccctggagccgcttgagctgcatgtccaggatggcctgggcctgcacgtcgctgaggccgaagcggttcatcaggttctccttggcgtcgtcgtagctctcccggatggtctggatcaccgcgtcgatgttgtcctcggcaatcagcaggccctccagcagatgggcccgctcctgggccttgcgcagatcgtagcgggtgcggcggacgatgacctcctcctggaaggcgatgtactcgtccaggatgtggcgcagggagaggatcttgggctggggctggccgccggactgcaccagggccagcatattgatggcgaaggtggtctggagctgggtctgtgcaaacaggcggttgagcaccacctggggattggcgtcccgcttgagctcgatgaccacccgcatgccgttgcggtcggactcatcccggatgtcggagatgccctccagccgcttgtcctccacctggtcggccatgttcttgatgagcatgcgcttgttgacctggtaggggatctcggtgacgatgatgcgggtgcggttgttgccgaactcctcaaactcggtgcgggcccggacgcacacccggccccggccggtggcgtaggccgcccggatgccggagcggcccatgatgatccccctggtggggaagtcggggcccttcacgtgctccatcaggtcggacagctccgcctccgggttgtccagcacgcagatcgtggcattgattacttcccgcaggttgtggggcggaatattggtggccatgcccacggcgatgccggaggagccgttgaccagcagattggggaaccgggagggcagtacccggggttccttccggctctcgtcgaagttcgggtcccagtccaccgtgtccttctcgatctcccgcagcatctcgtcggagatcttggccatgcgggcctcagtgtaacggtaggcggccgggggatcgccgtcgatggagccgaagtttccgtggccgtccaccagggggtagcgcatggagaaatcctgagccaggcgcaccagggcgtcgtacaccgaagcgtcgccatgggggtggtagcggcccagcacgtcgcccacgcaggtggccgacttcttgaagggcttgtccgcggtcaggttgtcctcatacatggcgtagagaatgcgccggtggaccggcttcaggccgtcccgcacgtcgggcagcgcccggcccacgatgacgctcatagcgtactcgatgtagctctgctccatctcgtgcaccagataggaggtctctatcttctggtctggaaaccggatttcctccggatcatactgtggctttttactcatgtatctgcctcacattcttcgtgatagggtggttcacggcgggcggccgcaagggccgcccctacaaattgcgggtgggcgtttcgctgttcccggcgattttttcctttgtaggggcggatgccttcctccgcccgtttttgttgcctgggcggcaccggaacgtcaggccgatgtgggcatcggcccctacgatacgcgttccggccacgttgtccgttccccaatcccttaatagtccaggttgacggcgtacttggcgttgcgctcgatgaactccttgcggggctccaccttctcccccatgaggacggtgaaggtctggtcggcccggacagcgtcgtccagctcgatgcgcttgagggtgcgccgctccgggtccatggtggtttcccacagctcatgggggttcatctcacccaggcccttgaaccgggagatgtccaccttggcgttgggattgtccccccgcagctcggcggagatggcgtcccgctcctcctcggagaaggccaggcgggtggtcttgccgcggctgagcttgaacagggggggcacggcggcgtagacgtagccgtgctcaatgaggggccgcatgaagcggaaaaagaaggtgagcaggagcgtgcggatgtgtgagccgtccacgtcggcatcggccatgatgatgaccttgtggtagcgcagcttctccagatcgaagtcgtccccaatgcccgcgcccagggcggtgatgacgggggtgagcttgtcgttgccgtagaccttgtcggcccgggccttctccacgttgagcatcttgccccacagggggaggatggcctggaagcgggagtcccggccctgggtggccgagccgccggcggagtcgccctcgacgatgtagagctcggtgagctccgggttgacctcgttgcagtcccgcagcttgtccggcatagcggctccgcccagggcggtcttgcggcggatggactcgcgggccttgcgggcggcctcccgggcccggttggccatgagggccttgtccagaatggcgcggcccaccgccgggttctcctccagatactcggagagcttgtcggtgacaatgttgttgaccagggtgcggatctcgctgttgcccagcttggccttggtctggccctcgaactgggcctcggtcagcttgacggaaatgacgcaggcgatgccctcccggcagtcttcgccggataccttgtcatcgtccttgagaatcttcatcttcttgccgtaattattgagcaccgtggtcagggccctcttgaagccctcctcgtgcatgccgccctccggggtgtggacgttgttggcgaaggagacgatgttctcgctgtacccgtcgttgtactggaaggccacctccgccatggcgtcgtccttctgtcccgccatgtagaccacatcggggtggaccgggtccttggactggttgaggaaggacacaaactcccggatgccgccggcgtagtgcatggtgtcctcctgctcccggccggggcgctcatcaatggtatgaattttcagtccggcgttgagaaaggcctcctcccgcatgcgggtgtggagggtgtcgtagctgtactcggtgatctcaaacatctcggggtcgggcttgaacaccacctcggtgccgtggcggtctgtgtcacccaccacctgcatgggctgggtcaccttgccccgggagaacttcatctcgtagaccttgccctccttgtgaacccgcacctccagccactcggacagggcgttgaccacgctggcgccaacgccgtggaggccgccggacaccttatagccgccgccgccgaatttgccgccggcgtggaggatcgtgaacaccacctccagggcgggcaggccggtctggggctggatatccacgggaatgccgcggccgttgtcgatgacggtgatgatgtccccctctccgatcttgacggtaatctcgtcgcagtagccggccagggcctcgtcgatggagttgtccacgatctcgtacaccaggtggtgcaggccgctctccgacgtggagccgatatacatgccggggcgcttgcggacggcctccaggccctccagcacctggatctcagagccgccgtactcgtgctccacctgggtagtgctgttctcgaattcttcagacatttgaaaacctccattgggatatccgggcggccaggggtcgcccctgcggccccgccgcaggagccgcctccggcggcccgtttggattgtttattcgaagctgttgttctccgcccgccggagcagcgtggcggtggacaactgggagagatagacggtggcctccccgcccgccgggcggcagaggacaaacgacttgggcagatcctcggccacattgactacctgcccggcctgctcggcccgctccaggaacctgcgggtcaggtgggaggcgctggtgttgtccagatcaaagagggcgagcacgtcccggtagggtaccacaacgccctggcccagatgcagatacattcagcgagcccccttatccttcaccacccgcgggccccacagccgtttccacagccgccagcccgccagcaggcccagcagggcaaacagcgccggcaatcccggcacaaagagcagttgggtcagcggagactggtcggactcccaaactccggcccgccccacagccaccgcagccgtcagcgcgacggccgccgccgggggaagcagcttccaccaacgccgccgggtcagccggcacaccagatattctgcaatcagccccgccagaaagggcagcgcacaaaagataccgataataatgggcatatgcttctccttggatgcgtccatgtgtggaatgaaggattgcacgggccgccgttatcccgccctatatgggcagggggtacggacaccttcccctatggcttcagcgccccgccgtgaatgtggaagaccttcccctcctccagaccctccagccgggcgtcctcacagcaggtgatgaacacctgcccgccgttgatgcgccggagcacgaactcctgccgccgggcgtccagctcgctgagcacatcgtccagcagtagcaccggccactcgccggtctcctgataaaagatctcccgggaggccagcttgagggacagcgccgcggtgcgggtctgcccctgggaggcgaaggtcttggcgctcatgccgttcagctccacggtgagatcgtccttgtgggggccggagaggcactggcgggactccagctccgccttccggtggctctcctgatgggccaggagctgggggaggatgctccgggggctgtcctccgggtcggtgacggtggataccgtctcataggccaggcccagcttctcccgcccgccggaaaagtccagatggatggggggtgtcacctcccgcaggcgcttgacgaagtgggcccggtagtggatcagcagggccccggtctgggccatgcgcaggttgaactcgtccagggtgtccagcagggaggggtgctcctcccagtcccggagtatgcggaccttatgctcgtagaggcggcgatactccgccagggcctcggcgtacttgggccggagctggcagatacacccgtccaggaaccgccgccgggtagccgctccctcccggatgaggtagaggtcctccgggcagaagagcacggtgttgagcacgccggacagctccccggcggacttgaggcgcaccccgttggagtagagctgccgccgcaccccccggcccagacgggcctccagggtgaagtcccgcccacgggcggatacctccgccttcacaaaagcatggtccacgccgaactggatgagctcccggtcgtaccgggcccggtgggaggaggcggtggacagataggccaccgcctccagcagattggtctttccctgggcgttctcgccgtagatgacgttgacctccggggaaaaacgggcgtcaaggtggacgtagttgcgaaaaaaatccagggcaatggagtggacaatcataccactttcagtgtcacgccgtccagcgaaacggtgtcgccggggcggattttccggccccgcatggtgcaggtctcgccgttgaccagcacctcgccgtcctgtatacgctccttggcctccccgccggtgcccgccagtccctcaaacttgagcagggcgtccagcttgatgaattccgtggtgattttgacttgccgttgttccatagtttgttcctctctcagtcaggggtggtgagggcctccagccgccggtagacctccggcagggcctttttcagcgccaccggccggcccttggcccggtcatagaagaagtggccggaggtgccctccgccttcagctccccggtggacgcctcccgcatctcgtagcccagctccagcttggccggggacaggcggcgtatggataccgtaatggccagctcctcgccgaagcgggtcatggcccggtatttgcaggaaatgtccgtcagggcgaagtcgatgcccgcctccaccgccctggcgtaggggaagccgagctgatccataaaatcggtgcgggactcctccatccagcggacgtaattgccgtgccagatgatgctcatgccgtcggtctcgtagaactggggccggcgaaggtagggcttgatctccatgctcactcgcccgccttcagccgcacgggcagcaccatgtagaggaagttctcctccccctcggtgggcaggatgacgcagggggacacgccggtggtcagctccagccgcaccttgtccgccggggcggccttgagggcgtccatcaggtacttgttgttgaagccgatctccagtccgccgccgtcgccgctgaggggacactcgtcgtaggcgtcgccgatggcggtcttggtggagatcttcagcagattgctgtcaaatacgcagcgcaggggacttttcagcttgtcgctgatgatgagggacacgcggtcgatggaggagagcagggcgcgggtctccccctccacatgaatggtgttgttgcgggggatggcctggcggtaggccaggaattcgccctccagccggcgggacaccagcatggtgtcccccaccttgaacatcacgtggcgggcgccctgggtgacggaggccggctcgtccacgtcgctgcaaattttttccacttcggacagggccgcgccgggcactacgaaagagaaggtctccgctccctccttcttgtcgatggcctcgtggcggagggccaggcggtaaccgtccactgatacgatggtgagaccgttgctgtccacttcaaacagggaaccggtgtggatggggcggctctcgttgtcgctgacggcgaaaagggtctgactaatcatggcttttagcctggattgcggcagaatcagggaattttggtattctacggtgggcagctcggggaattcttccggatcggtgcccagaatgttgaattcgctcatgccgcatttgatgttgaccatatagttttctgattgaaaggtgacgatgtcgtcgggcagcttgcggacaatttcaccaaacaggcgtgcgcccagcaccagagtgccttcctcccggatgtcggcagggacaatggtgcggatgccggtctccaggttgtagccggtgaggcggaggtcgttgccggcctccagcagaatcccttccagagcgggaatggagcttttgggagatactgctctggatgtggtggagatggcggcctgtagcagagctttttcgcaggaaaatttcatgattggtgacctccattttgtagtgagtgtgcgtgaatccccggagaaaggggagaatgagatcgtaatagtaagccgtaggggaaaatgatgtggaaaaacggcggaatccgctgggggggaagggctcccgtttccacagggggtggggatgtttttgtcgcctttccaccgatgaggacgaagggatggatttttccacacagggttgtccacatcttcacaaaataccgtggaaatgtggacagaacggtcaattattcgtagcgggcattgatgttggcgttgatgtccttgataacctcggcaatctccgggttggtcttagtcagcttctcgattcggtcaatggagtgcatgacggtggtgtggtcgcggccttcgaactccttgccgatctccttgagggagaggttggtcatgcggcggatctggtacatggcgatctgccgggccagggcggtgtccttggtgcggccctgcccccggagggcgtcggcgtcgatgttgtagaacttgctcacctcgtcgatgatgatgtccggcgagggcaggaagtcggccttgtccttgaacatgtcccgcaccgcccgggttacggtgtccacgtccacgctctcccccatcagctcctggaaggcaaggattttgttgaccgtgccctcgatctgccgcacgttggaggtgatgttctccgcgatatactggagcaccgggtcgggcaggttcatgccgcgccggatggccttgtttttgatgatggccacccgggtctcgtagtcgggcggctggatgtccacgggcaggccccactcgaaccgggtgcgcagccggtcgtccagccgcagcatctccttgggcggccggtcggcggtgaacacgatctgtcggcctgcttcgtacagggtgttgaaggtgtggaacatctcctcctgggtggactcgcggccggcgatgaactgcacgtcgtccatgaggaatacgtccgccgagcggtacttctcccgaaattcggggttgcgcccctcacggatggcctggatgagctcgttggtgaaggagtcgcccttaatatagacgatccggtagtccgggtggttctggtggatcttgtgggcgatggcgtacagcaggtgggtcttgcccaggccggactcgccgtagatgaacagggggttgtaggtctgggcgggccgctcggccaccgcctgggccgccgcgtgggcgaatttgttggacgcgcccaccacgaaccgctcaaaggtgtactcctcggtgcccggcagaaagacatcgtcggtttttttcttgccgaagtcctccagctcgccctctcccaggactaccacctcgaagtcggcggagaagagctcgtggagcgccttctggatcacgggcagatagcgggccatgatgatgtcccgcttgaagttggagggggtgtggagcacaaaccggttggcgtccagcgccacgggggtggcgtcgtcaaaccaggtgttgatcgtggtggcggtcatatccccctccatgagggagagcaccttgggccagatatcggccgggaaattcacggaaagaccacctctttcggaaaatatcaatagcactttattataccaaaaaattgccttaaaagcaacgtatactactaaaaaaagaatctctttttttaaagatttctccaccgggccgggatcggcgctgcttccccgttacctgcttgggactgggggctgcggccccggaaccccatggagccgggcggcggtacgttgtacgatggcggcaagacttgaaggcggttgcggcccgtatcggctggcgcgtgtcgatgctttgcctgacggccccggcggattacccacccaatttggcggcatgtgcgctgtacttgcctgggcaacgccaccccggactgcggtgcgccggacttgccgcggtccctgttccccgctctgccggaaatgccgccgggctccgcccggcctgttttttacctctatggtcccctatgcgcctaccctccgcgcttctctgtcacgctgcggctgctgcgcgacgccacactgcttacccctccgcgaaaaacaccttgcgcctgcggcgcaactgctttttcgtctgcggggtgcgctgtgcggctgctccgcccgcctccgcgcttctgcgtaggggcggccctagtggccgcccggccgaagcctgggacggggaggaaagaggcgggcggggacaagtcccgcccctacgggtgagtgttggccgagcgggcccaatgggcacaagatgtagtacccggcgcggaagcaggcccaaaccgcaaaaaagattgcaaaaatggtgttgacaggctattttgagataggctataatatcatctgcatcgtgcaggcctgcacggtgtaaagcagtttactttgacgaccgcagccggaaggctgttgtggtgggcggccctgccgccggattacagtacaggaggtgtaccgacatggtccgtacctatcagcccaagaagcgccagcgctccaaggagcacgggttccgtaagcgtatgcgtaccgccaacggccgcaaggtcctggctcgccgccgcgcgaagggccgcgcccggctgacccactaatgggtccgcgaatggaatagggctttcagaaggggcgggggagttttcccaccgcccctgcgcagcatacggagaaatcgaggaggcggcaggcgtggagcacaccgtttcgctgaaactcaatcacgtgttccgccgcctgtacggaaggggaaagagcgcggtgaatccgtgcctggccgtctactgccggaagaacaacctgggctacagccgcctgggcctgacggtgggggtcaagctgggcaaggccgtggtgcgcaaccgcacccgccgccgaatcaaggaggcctaccgcatccatgagggggcctttctccccggctacgacatcgtggtggtggcccgggtgcgggccgcccacagccgttaccgggagttggaacgctcgctcctgtctctggcggacaagctcggcctgctccggaaggagggggcctgattgaagcgcctgcttctggccctgatccggggctaccgcacgtacatctctccctcccgtcccccctgctgccggtttatccccacctgctcggcctatgccctggaggcggtggagaaatacggggcgtggaaggggggctttctcgccctgcgccgtatcctcaaatgtcagcccttccacaagcaggtttccattgagtacgatccggtcccgtaaggggctcaaactgaacttggaggcgcgcaaatggattttgcacagattatcctctccccctttgtgtggctgctgaccttcttttacaattttttcggcagttacggcatcgcattgatcttattcgcggtcgttgtcaagcttatcctgttcccgtttgcgctgaagggcaagcggagcatgattcagatgaacatgcttcagggcaagatgcagaagctgcagaagcagtacggcagagaccgtgagcgctataatctggaggtccagaagctttatgagcgggagaaggtcaaccccatgggcggctgcctgtggtcttttctccctctgctgattctgattcccctgtacgccatcatccgccagcccattaagtatatgatgggcatcaacgatgtggagatactcaaccagattgcccaggtggtggactggaactccattgcggtgagcaacggctggatcaaggaggccggcgaagctttctccaatgtgggctataaccagctttacctgtcctccctgatcaccccggaaaacctggaggcggtcaaggccgctgtgggcgaggtgggcagccggattttcgccgtcaactttgatttcctgggcctggtggatctggcccgtattccaactctgaaattctggaccgtggcgggcggcttcgccctgttcctgctgcccgtggtgtccgccggttccagcctggtgttttccttcatctccatgaagaccaacgccgtcaaccagcaggccgcccaggcggggaacaacgccagcatgaagtccatgatgatcatttcccccctgatttccctgtggatcggcttctccatgcccgccgccctgtgcctgtactggattgcccagaacctgctgagcatggtgcaggagttcatctgcggcaagctgctcaaaaaggactacgagaaggccgccgccgcccgggccgagcaggagcgcctggagaaggaggaggagaaggaggagcgccgccgcaaggccgaggagcgcgcccgccggatcgaggaggccaagctcaacaagggcaagaaaaagaagaccgagaagaagcacgacgaggacgaggacaagatccccggctccgtcaaggagcacagccgcgtgggcctgcgccagtatgcccgcggacgggcctacgacccctaccgctacagcgaggagggtcccaccgcctaccccggagaggcccccatcttcccgcccagatctgactcccgcgcgctgaagcgggaggcccatgagatcgaggaggagctgcgggagatccacaccgacgaggccattgaggacgccattctggaggaaaaggccctggaggcccctgtccaggaggagacggaggttgtctccgccggggaggagtccgaggctgaggacgacaccgacaagacaaaggaataacggccctgccgtggattcataaggagagatgcccattatgctgaaatggatcgagagcaccggcaagagcgaggaggccgccatcgaggccgccctgcagaagctgggcatggaccgggatgaggtctccgtggagattctggagcgggccaagtccggatttttaggcatcgggagctgcccggccaaggtcaaggtgagctatgaggcccccgacgagccggaggagcgccccgctccggcggaaattacccatgccgaggcggagccagtcaaggcggcggagcccgccgtccgggaggaggccccctcccccgccgcccccgtggccgagggggagaaggcggagcgcatcgacgcctttctcaccggcctgctggcccagatgggggccgaggccagacccgtcatccggatggatgaaaacggaacctatcaggtggagctggtgggccgggagctgggcggcctgatcggccgccggggcgagaccctggacgccatccagcagctcaccggctacgccgtcaaccacggccagtccaagcgggtccgtattcatgtggacgccgagggctaccgggccaagcgggaggagtccttggtccgcctggcccagaaggtggccggtaaggtggtcaaatatcgccgcaacgtcaccctggagcccatgaacgcctatgagcgccatgtgatccacaccgccctccaggagaccccggacatcaccacctactccatcggcactgagcccaaccgccgcacggtggtggcgtacagccggggcgagcaccgctgactcagagagagcggcgctttgcggagacagttatgacaaatggaaagggcgcccgtcggggcgccctttttccacaagcgaggaagtatgtgtgaataaaacggaactgctgaataagctggcccgggacaacggggagcggctgctcctggcccgggcgctggacaagctggagctggcccggcagcggaacataccggcctgcaccggctttttatccccacaggagcgggcgagtgtggaaaacctgctcaatacctgcggccatccccgccacctcttcttcggcgggtacgagggagcggagcgcaccgtatgcgccttcctgcccgactggcaggaggcggaggactggcagggggacggggagagctgtcccgtccgcgccctgcggtgcacctggagcggcggccaaaagcttacccaccgggatttcctcggctccatccttggcctgggcctggaccgggagaaggtgggcgatctgctggtgggcgacgggcgctgcgacgtgctggcgctggaggaggtcgccgactttctggtgttccacatggagcaggcggggcgtgtaaaactcaagtgttcccttctgcccctggaccggctggagcccccggcggtggagaccagaaccattcgggacaccgtcagctccctgcggctggacgcggtggccgcctccggcttctccctgtcccggggcaaggccgccgacctgatcgcctccggccgggtgcagctcaaccaccgggaatgtgtcaagcccgaccacgccgtggcccagggggacgtgctgagctgccgggggctgggcaagtgcgtgctcacagaggtgggcggcccgtccaaaaaggggcgtattctcatcgtattggagcggtatgtataatggaacaggcaaaaatcgaccggatcaatgccctggccaaaaaggccaaaagccccgagggcctcaccccagaggagacggcggagcgggaccggctgcggcaggagtatatcgccgcctaccgggccagcctggtgagccagttggaaaacacctatatcgtggagcccgacggcaccaagcataagctggggaaaaagccgtgaaaaaaggccgcccctccgttgggaggggcggcctttccggtacatcggaggtcaaaaaacacgtaccacaatccacgtgcccagggcgagctgcaccagcagcagggcgggcaggccgtacctgaaataccagtggcgggtcttgtgccgaaaggtccacatgcccaggagggcccccggcgtgccgcccagcagggctacgcagaagaaggccctctcgggcacccgccagcggtcgtgcctggccttccacttgtccacacccatgaggacaaagtccaggaggctggcgcacagcacccagagcagaaaatacttcatgccgggtcccccagggcggccacaaagccgccccgccgcttggtggtctcgtaccagagccttagatcgatgcgcagtgcgctgccgctgtccagaatgaccgccgtggtgtcctccagagcggtgatggtgacccagtgccagtaatccagctccttcaccctgccgttgtggaggttgaggaaggccacgggacagtcccgctccagggcgcggcggacaaaggcctcgacctgctcatagggcgggcgcttggtgcgggcggaggggaatacgaacaggccgggggtcagggtgaggccccgggcggcggcaaaggaggccatgccctctgccatctgctccggccggttgagaccgtgggaaacaggggtcacgtgctcccacacccggcacatcaggccggtgaaggaggcgcggtccatggccccctccgggtagaggggggccagctccggccgggtccgggccagataggagaggatgacggcggcggcggtggggccgcagcccgcccgctgctgccacagatcgggaaaccagtcctgatccgccccgtgggtcacggccccgtcagggccggtgatatccatccacgcgggatgggcgatggaaacatgcgcgctcaaggtcacatctgcctttctttttgggttgactgtgcccagtataacacccgccgcccggcccgtcaaaggttgtctttccgccgggggcgtgctatactgtccgggtacgaaacaaaaaggagtgtaccgccatgtcccagctctctctcaccgagggaaatgtcaggcgggcgttaagccgctttgccatccccttcctcggtgcttccctgctgcaatttctgtacggcgcggtggacctgatcgtggtgggacagtttgccgaccaggcgggcatcgccgccgtgtccaccggcagccaggtcatgcaggcggtgaccaattttattatcggcctgtccaccggcggtacggtgctggtggggcagtacctgggcgcccggcggggggaggacgtaaaccgggccatcggcaccctgttttccctctttgccctcatcgccgtggtcctggcggccgccttcgccctgtccaccaacgccattgtggcgctgatgcaggtgcccgccgcggcggcggcgcccgcccggcagtacctgtttatctgcgcctgcggcctggtgttcatcaccggctacaatatggtcagcggcgtgctccggggcctgggggactccaagcggcccatgtacttcgtgctggtggcctgcatcatcaacatcgtgggggatcttctgctggtgggagtgttcggcctgggggcggcgggggccgccctcgccaccgtggctgcccagggggtgagcctggccctggccctggcggtactccgccgccgggacttcccctttgattttaagcggcgttcctttcggattcagggggacaaggcggcccgcatcctccgcctgggcctgcctgtggcggtgcagaatgtgctggttactctctcttttcttatcatcaccgccattgtaaaccacatggatgttctggcccaatccgccgctgtgggcctggtagagcgcatcaccggctttatcatgctcttccccatcgccttccagtcggctatttccgccatgaccgcccagaatatgggtgcgggccgccccgaccgggcccggcaggggctgaaatacggtatcctgttttgtctggcggccgacatcgccatgtttgtcctggttcagcttgtcccggggctggccatgcggctgttcacccccgatgccgaggtgatctaccacggggtgctctacctgcgcacctacagcatcgactgcattctggtcacccttgtgttcaccctcaacggtttttacagcggctgcggccgcaccggcttcaccctgttcaacagtttggcatccaccttcctggtacgggtaccggcggtatttttcatcagcctgctccccggtgtcactctgctgcacatcggtgtggccgcgccggcggcctccgccgtccaggtgctcctccagctcctctacttccgcaccggccggtggaaccactcggttctgggggaggcgcagacatgaccgccgaagtgctggccttcctgggaggcgctccgggccccatttccctctttgaggcatgggaggaggccgtcctggcctgcggggagagcaccatgaaggtgtccaaaacccagatttcctggggaaacccccttcagtttgccgttctctcccagccccggcgggccgcccagcggcggaccggggctctgctggccaccctggggctgggccgccgggtggagcacccccacatcctccaggccgtggagccctatcccggccgctggacccaccatctgctcctgaccgcaccggaggatgtggacgggctgctggcggcctggctggccgaggcctaccgctttgccagggaaaaacagaggcgcgcctgatcccaggcgcgcctctgtgcgattggcaataaaccctcctgctaaaacgttcggagggagggatagtgtgaaagggaaccgtcagggttccctttcgcgttttatcaaacaactttttgaaacttcaaaaaagtttcaaaaagttcagcagcctgtcgaaaaaactttttcgacaggctggcagaggcgcgcctgatttcaggcgcgcctctgtttggatgtgtcagggacgcaggccgctgccgccctgcatggtgatggtctcgccggagatatacttggcatcctctgagcacaggaacacagcggtgcggccgatgtccttctccgggtcgccgaagcggccggcggggatacccttgatggtctgctcgtataccgccggatactcctcccgccacttcttgagggcgtcggtcatcaccagggggcaaatgaggttgcagttgatgccgtcggggccccactcggtggcggccacacgggtcatgccccggatgccctccttggctgcggcgtaggaggactggccgggcttgccgaacaggcccgcgccggaggcgaagttgaccacggagcccttcgtctccttcaggtaggggtagcagtgcttcatatagaagaaggcggcgtacaggccggagtagatggcctggtcaaactgctccttggtgtgctcggccagggggacgccggaggccgagttctgggcgttgttgatcaaaaagtcgatgcggcccaaggtgtccgccgcctgcttcaccacggccgccacctgctcctccacgccgccatcggcctggcaggccagcaccttcacgccgtagagccgctccagctcctccttggcgtcgtccagcttcttggtgttccggccggtgatgaccagattgcagccctccttggcgaaggcggtggacaggccgtagccgatgccgccgcccttgccgccgccggtgataatcgctactctgccgtcaaacttacccatatcgtctcctccttgaactttttagttttattttgatactatttgtatcatactcctttcgacggcggattgcaagagaaaactacctgtatacggcggttttagggaacatatgtttgcattttaacccaggctatgctatactggcttgggagtataccaataaggagggtctgccatgaaaacgctctcgcccaagcaacagcagatctatgactatatcgtttccttctccggcctccacggctatcccccctcggtgcgggagatcggggagtatgtggggctcaagtccccctccactgtccacttccacctgaaggggctggaggcggcggggctgatcaccaaggccgagggaaagacccgtgccattaccatcagcggcccacacccgggcgcgccggagccggcgggagaggagcccgaccaggtgcctgtggtgggcagtgtggccgccggagcccccattctggcccaggagtgcattgaggactatctgacctttgacaccggaggactgacaggggagcacttcgccctgcgggtacggggggagtccatgaggtacgcgggcatcctccccggcgacctggtggtggtacaccagcagcaggacgcccgcagcggggagatcgtggtggccctctttgaggatgaggccacggtcaagaccctgcgccgcagggacggacacacctggcttatgccggaaaacccggactatgagcccattgacggcgacggctgtaccattctgggcaaggtggtggccgtggtgcggaggtactgaggttgagtcctgtgccgaagcccagttggatgaaacaatgaataagggattatactgctcatgtccgcccgcaggcggaagaaaggagtctgaccgatgggaaagaacgaccgctttcagatcatctatacccaggggatcacggatatcacccgtatcctgctggacacccggacgggggtgctctacctccagacggtgagcggctatgccggcggcctcactccccttctggacagcgagggcaggcccatgaaatggctgccggaggagggagaggcatgagactggttacctggaacgtcaacggcctgcgtgcatgcctgggcaagggttttctggacttcttccagcgggtggacgccgacgtggtctgcctccaggagaccaagctccagcccgaccagatcgcactggagctgcccggctaccggcttttctggaacagcgcggaaaagaagggctactcgggcacggcggtgttcacccgggtggagcccctgtccgtcacctgcggcatcggtctggacgagcacgaccacgagggccgggtcatcaccgcggagttcgacggcttcttcctggtctgctgctacacccccaacgcccagaacgagctggcccgcatcgactaccggatgcagtgggaggacgacttccgggcctacctcatagagctggacaaaaagaagccggtggtgctgtgcggcgatctcaacgtggcccatgaggagatcgacctgaagaaccccaagagcaaccggggcagcgcgggcttctccgaccaggagcggggcaagatgaccgagctgctctccagcggctttaccgacaccttccgcgccctctaccccgaccggacgggggcgtacacctggtggagctaccgcttcaacgcccggaagaacaacgcggggtggcgcatcgactactttatcgtgtccgaccgcctgcttccccgggtgagggacaacatcatccacgcggaggtggagggcagcgaccactgccccgtggagctggtgctggactgatcatccaaaacggagcccccgccggcacacgccggcgggggccttttctcttgccgcccgtcactccttcagccccagcagcacctgccccgccgcccgggcaaaaagccgcgccccggccagggcctcctgaagggtgttgccgtgggtgcccacctccaccagcagagaaccgttggagagctgctggttgtaccgggaggagcgcatggtcatgggccgggccagggtgggatagagggtgttcatgctctcctggatgcggcaggccagggacaggttctgcatccagttggggtgttctcccccctcgctggagcccagcaccagcatgacctgggcggtgtccaccccgtcgatccgggtgacggccttgtataccgtgccgtcctcccccaccagggcgtcccggtggacgtccagcacgattttgatggagggatattgctccaggtaccgctgtaccgcctcggcggagcggtcataggccccgttgtacttggggtagtcgtatagggtgcggtcgtgtaccacggtgaggcccagctcggtgaacacccgctccatctcgtcccctacccgaaccacgttgtagttttcgtccagagtgcgggtgttgttgtccgagggctcgtaaatgtcggtgccgtcgggcgtgtaggcctcgctgccgtgggtgtggacgatgagaatctggggcccctccgccgggagggcaatgtttacgggggctgccgcggcggcggccagatccacgtccagcccggtgcggttgtagaggtacaggcccccggacacctcatagccctgggtgctggtgggaaccagggtacgggcgatgatgtcctccggcgcggcagtggtctcgggaggcggctcgctgatgtcgtcgtgatcctgggcgggctgcccggcgggcagatcgggggtggcgggcgcggagccgtccagatggccggccacggcgtccccattcccccgcagcagaggagactggtccaccaccaggcgggcccagccgctcaggccggacaggggaccgtcgtcctccgctacttgtcccagttctgcggagagggcggcggagacaaagccggggtcctgccccagactgcggaaggcattggcggcggagcctccgccgctgcacaccagcagggtccataccgccagggtggccagaaagagggcgagactgcggcggagcaggcggccccattgaattctgggcttcatagttcatcatcctttgtaagtaagatgtccccctcgggggcggatatggatctctatgcgccccacagggggaatatgccagagggcctgtcttgactttttcagtcaattcgatataatgcttttacgatcgaatgcagagggggcggtccgggtggagagccgcggaaaggtgctcaaccagtttctggtggaggtgtttggccagatcctgaaggcggaggccgcctgtctggccgggaaagacctctccctgcgggagctgcacctgatcgacgccgtgtgccgggcggtggaccagggcggggacaaccgctccaccgccattgccgccgccctggggatcacagcgggcaccctgacctccgcagtaaacctgctggagaaaaaggggtacctgctccgccgccgggatgaacgcgacaagcgggtggtacacctgttgccgaccgagcggggccgggccgccgacgcgcgccaccgggactttcaccggcagatggtggcccatgtcctggacggactgaccgacgaggaggcggagtgcaccctccgcgcactgggccgggtggccgagttcttccggcgcggcgcactggagcggggatgaacaagacctacatcgcaacgatgggagagaggttctttatgagcaaaatagctattgccacagacagcaacagcggcataacccaggcccagggccgggagctgggtatctttgtgatgcccatgcccttttacatcaacgacgagctctttctggaggacatcaccctgagtcaggagcagttttaccagcgtctggaggagggggccgacgttaagaccacccagcccgcccccggcgacgtgctggagctgtgggaacggattctgaaggactatgacgagctggtttacatccccatgtccagcggcctgagcagctcctgcgagacggcggtgatgctggcccaggattacagcggaagagtacaggtggtcaacaaccagcgcatctccgtcaccctgcggcagtctgcgctggacgcccaggccctggccgccgcgggccggagcgccgcggagatcaaggcgctgctggaacagaccaagtttgactcggacatctatattaccgtggacaccctcaagtatctgaaaaaggggggccgctgcaccccggctgccgccgccatcggcacggtgctcaacctcaagccggtgctgcgcatcaagggcgagaagctggactcctttgccaaggcccggggctggaaggccgccaagaagaccatgctggacaccgcccgcagggtgatggagaccgactttgccggctgccgcgggccggaggatcttcacatcgccgccgccttcaccggaacgcgggaggaggcccaggagtggctggaggagctggaggcggcctttcccggctaccccatccacatggaccccctctccctctccgtggcctgccacatcggccccggcgcccgggcggtcaccctgaccaaggccctccccatctgagcctgcctaacagagccgccggcatagccgacggcttttgctatgcaaacgcatagcaaaattggccatgttccgcttacagcggcacggccatgggatgactgcacgtgggccgttccggcccacgtgcgcaaacacttcgtgcacctagggcttgtttgaaaaatgtcaacatgcccaatcgacgggccttttgaccgctggacggcgcaattttttcttgaaatccgtcaggattcctgcgaaaaaattgcttgccagcggccccaaattcctcgccgctgggcacatcgccaattttcaaacaggccctaagcctttgcatcgtttcctggtgcaccctgtgcgcatgaggttttatgcggaatttaaaaaacatgcaaattttcttcacgctttatacataatttgcggttattctatgtaccgttaaaagaaatgaacccgtcaaaggagtgaccagttatgtataacagtgactataacagaccccctgaggagcgggagcccatagagaccgagcattttcacgtctgggacgctgagtcccccaagccccccaggaaaaagagcggggcggccaggtttgtggccctgggcctttgctgtgccctggtgggcggcctggtgggcggcggcggcgtactggccgccagccatctgagcggaggaaagaccactatttaccagggtacctcccccaacagcatcgtatccctggcccatgtggacgggcagaccgtcctctcacccgagcagatctacgccgccaacctgggcgcgacggtgggcgtcaacggcaatgtggataccaatgtgttcggctatacggtgaagaacgccgtatccggctccggcttcgtcatcggcagcaacggcagctccagctacatcctcaccaattatcacgtcatcgacggcgtcagcgacatcaaggtgtttttctccgacggcaagagctatgacgccaccctggtgggcggtgaaaaggagaacgacatcgctgtgctgaaaatcgacgtgggcaacctccagacggtcaccctgggcgattccgatcagctcaacgtgggcgaggacgtgtacgccatcggcaaccccctgggcgagctgacctttaccttcaccgggggctatgtctccgccaaggaccgctccgtcaccatgagcgatggaacggtaatgaacatgctccagaccgacaccgccatcaactccggcaactccggcggccccctgttcaacgagtacggccaggtgatcggcatcgtctccgccaagctgtccagcagctccaactccgaggcttcggtggagggcctgggctttgccatcccgatcaacgacgtgaaggatatggttacctccatcattgagcacggctacgtcaccggcaaacccaacgtgggcattctgatgaaggacgtgccccaggaggcccagcagtacggcgttcccgccggctcggaggtgctggctgtcctggacggctccggcgccggcaaggccggcctccaggcgggcgatattatcaccgctgtcaacggcactgcagtgtcgggcagcgaggccctcaaagccgccgtccaggactgtaaggcgggcgataaggtgaccttctccgtttaccgggacggggacacagtggagcttgagatcaccctggatgaggataaccagaccacccaggaggctatggagcagctccagaaggattatcaggagcagcaggcccagcaggaacagcagcagccccagcagaatggcggctattttccctggccctttggctggtaagacgtcagaatttagataaatggatgatagaagcagcggcgcacggatatccgtgcgccgctgcgattgcatataatgcctccggccaaaggcgccggagggagggaaagtgtgaaagggaaccgtcagggttccctttcgcgtaaaatagaatgactttttgagacatcaaaaagtccggcagcctgtcggaaaagtccggccggacttttttgacaggctacagcggcgcacggatacccgtgcgccgctgctttttaggtgactccccggtactttttgcgggttgcgataccgccccggatatgccgttccgctttattttcgtccagcacctgcttgacctggaggtaaagaggcttgttaaaggcgggcagacgctcgcttaggtccttgtggaccgtggatttgctgatgccgaacctctgggccgcgctgcgcaccgtcgctttgttctctatgatgtaaagcgccagctggcaggcgcgctcctcgatgttccctttcaaacagcaacactccccgcaatgattctcacggggcatgtatatgcgtcggagcggggagatatgttgcgcgcagttacgtctgcatgtttccggaaggtctggcgcagggcatgcaactggcgcgttcgacgatatggtagggcaagctaattttaacgggcagttggtgaccgccattgattcggtcggctagggtacggactgccatcttgcccatttcatccaaagggacgtgtatgctgcttattttgggctggacatagcgaacgtttggaatgtcgttaattccaataatggaaatttcgtcaggaacctgaacgcccaactccttgcaggcccgaagcgcgccgatagcggtcatatcattggcgcagatgacggctgtaatgttgcggttctggctgagaagctgcttcataccctgaagaccgccgtccatggagagcgtattgatttgaaccagatgctccggacaagggggcaggccgcataggcggagcccttctaaatagccacggtagcgtccctcctgctctgctccaataaaagcgatattccgatgattccggtcataaaaatagcgtacggtatcccgaacggcaaaaaaacaatcacagagtacctggtcacattcagcctccagattattgaggccaacatagacaatattgcggaatcgttttttcatggaggtgaggagcgagggctgaaaccgtcccacaatgatcaggttatctgagtcgcagcccccggactggcgtgctgccgccggagtttgaaattccagcatggaataggtgtatttcagtacaaagttgctttgaaatgcttcctgctcaatactggagataatgcgggggaaaaaggggtcatcccgtacctccccgggggaacaggcaattaatccgtagatagactgcataaccggggtgggctgtaaagcatgccggagctcgcgtgcgactggattggggacatacccggtttttcgaacaatgttccagatgcgctcctgtacctgagcgctggccgctttggtgtttggctggtttaaaacacgggagacagtggagatggaaacgcccgcttctttcgcaatttctttgagtgtcatgatacgcctccctgtttgaataatttgttattattttaacacaaattttgagtaaaacaagagatacacttaagaaattttatgaactctcgtgccaagtggcaaaatatttgtaaaattttttacattatgtgcaatatgtaaaaggtatactactccatattgtattaaatcaataaaattagaacaaaaaacaatcgattgcttaaaaatgggtgccaaagtttgagtaatattgttgaagttaatgatatagtgtgttaatatcttggtgtaatttagtaatattatatagtcataaaaagtattaggaataaacttaacttttcttaaagcaaatttgcgtaaattagaagaggtgattttgtgaaactggaatttgagtatgggcagggcctgctgggcgcggagctgcccgacagcacggatatcttcatccccggggagacggtagcggatccgccctgtctgccccaggactgggacagcctgtacgccgctaccctggcgtccatccgcaaccccatcggcatgcccccgctgaaggagctggccgggccgggcaagtcggtggtcatcgtcatcccggacattgtcaaggggggcaaccagcccaccagccaccggaaggtggccatccgtgcctgcctggacgagctgtacgccgccggggtggagcagaaggacgtgctgctgctgttctccaacggcctgcacccccgtgctactgtggccgagatgcagaccatcctgggccccgagctgttcggcgagttctaccccaccggccagatcaccagccacgacagcgaggactacgaccacctggtggacctgggctacaccgcccagggggaccacgtgatcatgaacaagtacgtctacgacgcggacgtggcggtgctcatcgggcacacccagggcaacccctacggcggctactccggcggctacaagcactgcgccaccggcatctcccactggcggagcatctctgcccaccacgtgccccaggtgatgcaccggcaggacttcgtgcccgtgtccacgaacagcgagatgcggcacaagttcgaccagcagggcatgcggatggaggagaagatgggcaagaaattcttctgctgcgacgccgtgctggacaccaagagccgccagatcgagattcactccggctgggccagggagatgcagcccgtgtcctggaagacggcggacaagcgcacctacgtccactgggcggagaagaagtacgacatcatcgtcttcggcatgcccaccaacttccactacggcaacggcatgggcaccaaccccatccagatgatgcaggccctgtccgcccaggtcatccgccacaagcgcatcatgagcgaccggtgcgtgttcatcgtgtcctccatctgcgacggctacttccacgacgagcgctggccctacctgcgggagctgtacgacctgttccagcacgactacatgaacatcctccccgacatgaaccggtacggcgagtacttcgccaccaaggaggagtacatccgcaagtaccgcttcgccaacgccttccaccccttccacggcttctccatgatgagctgcggccacctggccgaggagcacaccagcgccatctacatcgtgggcgcccgggagccgggcatcgcccgcagcatgggcctcaagacccgcgccaccttcgaggaggccctggccgacgccatgcgcaaatataccggccccaaccccaacatcctggccctgccccgcaccttcaccaccgccgccgtccacctctgcatgaaggaccccgccctcaactccgcccccgtgggcggctgcccctgcggcggctgagccgcaaggagtgaccgaggaaagaggggtgaggaaccaaacattgctcccggtctattgggttccaataattgaaaggagaatgattatgaaaaagctgttgtctcttgtactttcgtttgctcttgtctgcacactgatttccggatgtggcccgaaagggggaggaggaaactcgagcaaccagcctctggacgccgctgaaacgaccttcggcctgacgcccctgccggagcgcaccacactgaccatcggttttttctccggctctgcccactccatgccctggtatattgctgatagaatgggattttttgatgaattaaacatcgatgtggagtatgagtcctttatcggcggcccggcgatgatggaggccagcgccagttgggacatctgtgatgtgggtgctcccggtattctgaacggcatgaagaactatgatatccacatgctgggcctgtgcgacaacgagtacaataccgccctgtttgtccgtccggacagccctcaggccgccgatcctaccaatcctgaaatatggaaagggattgagtgcattctgcccaccggtacgaccctgcagtacatgttcctcagctatcttcagtcactgggactttccgcggatgacgtgacaattaccaatatggatgttacgcccgcgctgaccgccttcaatgccggagagggcgacgcactgtgcgtttggaatgccgtggcatacaacgccgaggacagcggactcgtccgtattaccgatgtcagcgaattgggcatcaacaatgtctgcggcctggcggccacaaaggatgctatggagaataagagcgacctgatcgacctggcctggatggtctattatctgacttgggactggtgccagcagagcgaggacaatatggcgcaggcggtggaactctatgtggagtcctgcgaggacgagggtgtggtatccaatgaaagcatctgtcagcgggctttggatatctttgcctgccccagcccctctgaggccgtcagcgtgatgactacagaggaagaggatcgccttagcttggcggatcgtccggtgttggccgctgaaaacgatctgctggagacaatggactttttcatctccatcggcagctatactgaggaagaccgtaccgccatccttgataaggagctggtgaactcctctgtggcggagcggtgcgccgagacgcttaaaacgctgggctatctggaataatcagctgcacatctgcgcaacccggggctgcattgtcgttccgcttaggcacgcagtgcagcctccttgcctgccaaacggcggggaaacttgttgtaagggggaagtaatatgcaaaatgcttccagcgcgggccggaagctgaccaacgaggagcgcgtcgaagtggtcaagcggcagaaaaagcgcaacagcttccaactggccatgctgtcggtcatcggcatattgggttttctacttctctggcaggcagctgttctggcgggtgttctgcccagccgctacgtcccggcgcctacggaggttatcgcactgtttgctacaaagctggtggatcccaatccggacggcgcggtactgggggttcacatcatggccagcctccaggtggccctgacgggttttctgctggcaattgtcatcggaattcctctggggctttttatgggctggttccggggattcgacaaatttatgcggcccatctttgaaattctgcggcccataccgccggtttcctggattccgctgaccatcatctggatgggaatcggcctgcaggccaaggcatttattgtattcttttcagcctttgtaccctgtgttatcaatgcatataccggcattaagcagtccagcccggtgctgatcaatgtggccaaaacctgcggagcctccaattttacggtgttccgcaagattggaattccgtctgccatgaccatgacctttgctggcatccgcgtggccctaggaaacgcatgggccacgctggtggccgctgagatgctggcggccaatgccggacttgggtacatgatcctccagggccgacagtttgcccgggccgacatcattatcctgggtattgttgtcatcggcgtgatcggcgtcattttcacctcggtcctgggactgctggagaagaaagtgctgaggtggaaacgatgaaacagagcagtaccagtgttgttgtcatgagcgacgcggagcgccgtgagagactccgcaaccggatttacgccgtgtttcctgtagtttccgtcctgcttctgatcctgctgtggtttttggccgcgggcgcggaaaacagcacctttccctctcctgtggatatttggaatcgatttctgctgctgatggaaaaaccgatcaagcagctcaacctctttggtcacatttgggccagccttctgcgcgtatttattgccctggcctttgcctggctgcttgggatctctttcggcattctgatcggctggaacaagaaggccaacgcactactggggcccctctttaccgcctttcgctccgtgccgcccctggcctgggtgccattgatgaccatgtggtttggcaccggtgaatttcccaaaattctgattgtatttatcggcgcgctgatgccggtggtggtcaacacgcaggcgggcatttccaatgtgcagaacatgtacctcaatgtgggtaccattttccacgccaacaagcggcagatgctctttgaaatcgctattccatcggctctggacgccatttttgccggtgtgagaacctctacctctgccggctggatggtggtgctggctgcggagatgctgggcggaaagtccggcattggtttcctcatcacccgcggtatggactccggagactatgccctgtgtctgttgtccatggtgtgtatcggtttggtcggcgcgctgctggccatcattacccagctcttagaaaggatggtttgtccatggacggcaaaaaagtcaaactgagactggagcatatttctcagagctacattgtcaaaaatgaggtgtcagacgccgtggttgacgtgtctctggatgtgtacgacaatgagtttctggtcatactcggccccgggcgctgcggtaaaactgtactgctgaatatgatagccgggctggaaaagccggtggacgggagtctcttcctggatggagaggagatccatgggagcgacgagcgtattggcatggtgtttcagaagctggcgctgatgccgtggaaaaccgtaatggaaagcgtagagttcggcctcaagatgaagggtgtgcccaaggctcagcgccgggagacggcccagaagtacatcagcctggtgggcctgcagggctttgaaaaaagctatcccagccagctctccggcggcatgaagcagcgggcaggcattgcccgcgcctataccaacaatccggagattatgctgatggacgagcccttcggacagctggacgcccagacccgatattccatgcaggacgaggtgctgcgaatctgggaaagtgaaaagcgcacctttatcttcgtcaccaacaatatagaggaggcactctatttggccgaccgcattgtgttgctgaccaactaccctgcgcaggtcaaggaaatctatgacatcaacctgccccggcccagagatacggtcagccctgagttcctgcgcctgcggaaaatcattagtgacaacacggatctggcgctctgacggaggtggttaaggatgagcgaaccaaagagtgaatacaaggtggaggttaagaacctcacaaaatattttggggatctgcacgtgctcaacgacatctcctttaatgtcagaaagggtgaatttatctgtattgtgggccctaccggctgcggtaagaccacgtttctcaacctgctgacccgcatttacatgccatccaagggcgaccttctgatcgacggagagtccgccgaccccaaaaagcacaatttggcctttgtgtttcaggagccgtcctctattccctggaagacggtggaggaaaacctgcgctttgggctggagctgaaaaagctgcccaaaaaagagatcgacgagcgggtggaaaacattatcaagctgatgggcctgcaaaactttcgtgacgcctatccgcaccagttgtcggtgagtaccgagcagcgtattatcatcggccgggccttcgccatgaacccggatctgctgctgatggatgaaccctatgggcagatggacatcaaactccgcttctacctggaggacgaggtggttcgcctttggaaggagacaggcagcacggtgctgtttattacccacaacattgaggaggctgtttacctcgccgaacgcattctgatcctgaccaacaaacccactacaattaaagaggacttcaaggtagaccttccgcggccccgcgatgtgacttcgccggagtttaccaaaatccgccagtatgttaccgatcaaatcaaatggtggtaagggaggcttttcaaactaatgtatgacgttctgatcatcggctgcggagtaattgggtctgccatggcgtatacgctgtcacggtatcaactgaaggtctgtgtatgtgaacggttcaacgatgtggccaacggagtaaccaaggccaacagtgccattctgcacgccggctttgactgcccgcccggcagcctggaggcccgcatgaacctggagggcattgctatggcccgggaaatctgcaagaaactagatgtagagtaccgggatatcccctcgtttgtgatcgcctttgacgagcgggagatggagtatgtaagggagctctatgaccgcggcgtggccaatggcgtaccgggcgtgcgtattattgaccgggaggaggcgctccggctggagcctggcctcaatcccaagctgatcggcgccctgtatgcccctggctccggtattattaacccctgggagtacgccgtcgccatggcggagacggcagtacgcaatggcgtggaggtgaagttgtcatcccgcgtaaccgggattgagcggaatgaggatcactttgtggtgataaccagttccggaagctatgaagcccgctatgttatcaacgccgggggggccttttccgcccaggtttatgagctggtggggggccacgggctgaaacagacaaatttttgcggccagtattacgttctggacaaaagccaggggggcatcattaactccgtggtattcccctgtcccgacgagcacggcttcaagggaatcctggtggcccccacggttcatggaaacctgattgtgggtcccgacgcatatcaggtggaggatggcgaccatgtggccacggtcgaaccctatctgagtcaggtgaagagcggaggactgcgctctgttccgggcattgacttccgtcagacgattcatgagtacgccggagtgcgtcccaatacgcaaataccagactttgttattgaagagtcccccatttgtcctcatttcatcaacctggcgggtatcaagtcacccggactctccgcagctccggccattgccctggagggattgcgcatactgtccgggtgcggtcttgagctgacggaaaaggagacgtttatcgaccggcgcaggcgcattaagttccgggaactcagcaatgcggagaaggccgcggtgattgccgaagatccgctctacggccgggttatctgccggtgtgaaactgtgacggagggggagatcgttgaggcgattcaccgtcccattgtcccccgttccattgacgccatcaagcgccgctgcaacgcgggtatggggcgctgccaaggcggattctgcggcccccgggtgcatgagatcctggcccgtgagttgggtgtttccccaatggatataacaatggatgaggaggggacctggctgctcagctcccccatcaaggaggtgtccgtccatgacgcttaactatcaggtggtagtggtcggcggcggccctgccggactggccgcggcctgcagcgcgcgtgaggcgggagcggagcgggtgctggttctggaacgggacaaggaaccgggcggcattctgaatcagtgcattcacaacggctttggactgcactatttcaaagaggagctgactggccctgagtacgcgggacgttttattcagcgggcttctgagctgggagtagagatcctactggatactatggtgctctctgtggaggaggatcacacggttcgtgcggtcaattgccgggacggactgctggagatccaggcggatgctgtcgtgctggccatgggctgccgggagcgtacccgtggggccatcgccattccgggagaccgtccggccggaatttttacagccggtaccgcccagcgatacattaacattgaaggctggatggtgggccgccgggtggttattctgggcagcggagatatcggcctgattatggcgcgccgcatgacgctggagggggccaacgtattggcctgtgtggaactgatgccctactccaatggattaaaccgaaacattgtgcaatgcctgaaggactatgggattcccctttacctctctcacactattacgaatatcgtggggcgggagcgggtggagcaggttgtggtctctgaggtaggcgctgaccgcaggccaataccaggtacggaaatcacgtttgactgcgacaccgttctgctgagcgttgggctaattcctgaaaacgagctgacccgcgccgcaggaattcccattgacagccgaaccagcggcgccgtagtttttgaaaacatggaaacggtgactcccggaatttttagttgcggtaatgtcgtccatgtccatgatctggtcgactttgtcacggcggagagccggcgggccggtgcagcggcggcccggtatgcggcggcaggtcagagctcccctgccctgtcctgcctggaggtgcagaatggcgcgggggtcacttatacggtgccgcagaagatacggcccgcccatgtagagaagggcgtggatctctttttccgggttgacaacgtgtaccggaaccgtcgtatctgcgtgacctcttcaggggaggagctatgcagcttctccagggagcacatggctccgggtgagatggagcacattgtcctgcccaagcgtctgctggagcgggcgggggacgggaaactgacggtttctctggcggcggaaaggggggcgaaggaatgacggagcttacctgtattgtgtgccccaagggctgtcgcctgaatgtggatgaggagaacgggtttctggttacggggtatggatgccccaggggaaaggaatatggacataaggagctgacagcgcccacccggacgttgaccagcattgttcggatagaaggggcaattcacccctgctgcccggtcaagacctcgggggagattccaaagagattgattatccaagccatgaatctgttaaaaaaagtccgcctcagcgctccggtggccgccggagcggtggtggttcaggatatctgcggaacgggtgtggactggattaccacaaagaatatgtagacagtcaaggcgctcaacagcccagaggccccggaaccagacggttccggggcctctgttatgctgattgcagttcgcccgccggaggcgggggtcatgaaggacagcgttccagattacacgttaaaccggaacagcacgatatcgccgtccagccccgcggaatacattccgcgggggccccgaattgaaaaacagccggtggaagtgaattccaccggctggcagggttttgcgggcaaaacgcctgcacggcgcaggggcgccgcgccgcctttggcgggattcatgaaggacggcgttccagattacacgttaaaccggaacagcacaatgtcgccgtccttcatgacgtactccttgccctcggagcgcaccaggcctttctccttggccgcgttcatggagccgcaggccatcagatcgtcgaagttgaccacctcggcgcggatgaagccccgctcaaagtcggtgtggatcttgcccgcggcctggggggccttggtgccccgtttgatcgtccaggcgcggcactcgtcctcgccggaggtgaggaaggagatcaggcccagcagggcgtagctggccttgatgagccggtccaggccggactcggcgatgcccagatcgtccaggaacatcttcttctcctcgccgtccagctcggcgatctccgcctccagcttggcacagacggggatgacctgggccccctccttggcggccagctcctccaccaccttgtagtaggcgttggcgtggcagtcggcaaagccctcctcatccaggttggcggcgtagatgatgggcttgagggagagcagctcggcggcggcgatgatggcggcgtcgtcctcgtcacagtcgaaggagcgggcggagttgccgtcgttgagccagtccttcagggcggagaacacctccacctcgcggagatacttcttgtcccccttggcggccttctgggccttgtcgatgcggcgctccaccatctccacatcggccatgatcagctcgatgtcgatgacgccgatatccccggcggggtccacgggcacgttggtgctggtgtcagctaccacatgcatgatgttctcgtcgtcgaagcagcgcaccacatgcacaatggcgtcgcactcccggatgttggccagaaacttgttgcccaggccctggcccttggaggcgcccttgaccaggccggcaatgtccacaaattccaccacggcgggggtggtcttcttggggtggtacatctcggtcagcgcgtccagccggtggtcgggtacggccaccacgcccacgttggggtcgatggtgcagaaggggtagttggcgctctcagcgccggcgttggtaatggcgttgaacagggtgctcttgcccacgttgggaaggcccacaatgcctaatttcatcggtaaaaaccctctttcggtatgttcgtttccacattatatccgatcccggtggaaaaaacaagcgcgccgggccaattcaaacagccgcctgcgcagcggtgggatgttctggccgtccgggcatttttgcaggggaaaacggcgcgccccccttgcttttccgacaggaagcgtgtagaatcttaacgctcctttaacgatacgacaaaatatggagggatctcccatgggactgctgcgccagcccaccagtgatatcaccaagggcgtgatctggaaacaactcctcgcctttttcttccccctgtggttcggcacctttttccagcagctctacaatacggtggacaccctggtggtgggccggttcgtgggcaaggtggccctggccgccgtgggctccacctccgtcatcgtcaacctgacggtgggcatcttcaccggactggcggccggtgcggtggtagccatcgcccagcacttcggtgcccgccgctgggatgaggtgcacgagtgcgtccacaccgccatgctgctgagcatcctcatcggcgcattttttatggtgacgggctttgtcctcaccccctgggccctgcgggccatgggcaccaccgaggaggccctgcccggggccatcctctatctgcgggtctatttcctgggtatggtgcccaacgtcatctacaacatgggtaccggcgtgctgcgggccatcggcgactttcggcggcccctctacttcctcatggccgcatccctgtgcaacattgtgctggatctgctgctggtggtagtgttccatatgggggtggccggcgtggccatcgccaccatctgttctcagcttctgtccgccgtgctggtggtgatctcactcatgcgctccgagatgaccccctatcagctctttcccaagcggctgcgcatctatgccatgcccatgcgcagcatcctgatgatcggtgtgcccaccgccctccagtcggtgatgtacaacgcctccaatatcgtcatccaggcctccatcaactcctttggcaccgacgctgtggccgcctggaccgcctacggcaagatggatatcattttctggatgaccattaccgccatggcccagtccatcaccacctttgccgggcagaactacggcgccggggagtatgagcgcctgaaaaagggcgtccgggtgtcggtggccatgacggcgtgcttcaccgtcctgctcagcactgcctttttcctgctggcccggcccctgctggccatcttctcccccgaccccgacgtactggaggtgggggtggagatggtgcgcttcctggccccctgctatatcacctatattctcatcgagctgctcactggagccatccggggggcgggcaagtcggtagcccccatgctcatctcggtcttcggggtatgcggcctgcggctgctgtggctgttcaccgtcgtgcccgcccaccacaccctgctggctgtggaggccagctaccccatcacctgggcggtcacctccgtggccatcctgctctactaccgcttcggccggtggctccacccgcccaagaaggcgtaaaagcgccgcccccatattttgcggggggacgccgtcattgcagagccgtaggggcgggggcccacacccccccgcggtcaatctgcggccggatcggcgggccgatgtgggcatcggcccctacgttgttcaggaggcggaacgatacccgcaggattgcaggggcgggtcctgtccccgccgcagggttggggcgggcggccacaagggccgcccctacatttggagggagcggtaccattgcagaaatgtagcggcgggtgtccacacccgcccgcggtcaatctgcggccggatcggcgggccgatgtgggcatcggcccctacgttgttcaggaggcggattgatacccgcaggactgtaggggcggggcttgtccccgcccgcgtctctcttgcccccgccgcagaagagaaagaggacgcgcacgccggaggtgtgcgcgtcctcttggtttagtcatggctcaggtagtagggcttcatcaggctgggctgctcggtggagtccttctgcccattggtgcgcagggtgacctccgggggacggccccggccgccgtggcgtccgctgcccttgcgcttccgtgccgcctggggctccggcttcgcagggggttccgggggcctggcggccttcttccgctttttagcgggctgttcaactggtttgtcctttttcggtgcggtctgggcccggccgcgaggggccagcaggcgggcggtggcgtccatgatcacgtcgctggccagggggtcgggcttgtggaagtcggcaaactccgtctgaaccggccgggcgggggcagtggccgtcagggcctcctccagggtggcgctgttgcgctggccccgcttgcggcgctttttggcggaggtctccccggctggctccggctggggaggctgctccagtaccttttggttggccttggcctttcgggcctcggcggcggccttgttggccgcatcccgctggcggcggcgctccttggcggcggcccgggcctcggcgtcctctggattcaccacccggcccttcttgtcgcggggcaggggctccagcacctccatgggccaggggtggacttccaccacagggatggcgcggccgatgagcttctcaatggccttgagctcgtccttctcgttgatgtcgcagaaggagatggcggtgccgccccgcccggcccggccggtgcggccgatgcggtggacgtaggtctccggtacgtcgggcaggttgtagttgaacacgtgggagagctcctcaatgtccaggccccgggcggcgatgtcggtggccaccagaacctgcaccgcgccgctcttgaagtcggccagggcctgctgtcgggcggtctggctcttgttgccgtggatggcggcggcggagatacccgccttgaccagatccccggccaccttgttggccccgtgcttggtgcgggtaaacaccagggcgtttttcacgtccagctcccggatgagggcggcgagcagcctggtcttgttgccgcggtccacgtagtagagcttctggtcgatcacctccaccggggaggagatggggttgaccgccaccttggcggggttgtgcagcagggagtccaccagcccctgcacctcggggggcatggtggcggagaagaaaagagtctgcttttgggcgggcagccagcccaggatgcggcgcacgtcgtggatgaagcccatgtccagcatccggtcggcctcgtccagcacgaagatctccagccgggacaggtcgatgagcttctggccgtagaggtcgcccaggcggccgggggtggccaccaggatgtccacgccctttttcagccgctccacctggggagcctggcccacgccgccgaagatgacggtggagcgcaggggcaggtacttgccataggcctcaaagctctcctggatctggagggccagctcccgggtgggggtgaggatcagggcccggatggggcggccctgggccttgcggccgctgagctgctggagaatgggggcggcgaaggcgcaggtcttgccggtgccggtctgggcgcagcccagcacgtcccggccggtcagcgcggggggaatggcttttgcctggatgggagagggctgctcgtagccctggtcggccagggcccgcaggatgggctcgttgaggccgagttcttgaaaggtcatgttgttcgtcctttacagcgttttggcccctcctgcgccggggggcggttgcgggtcataccccaccgcgcagaggtgggggaaaacgcggcaaagcccgccggaaaaccagcgggcatttcgcacgcgatattcgtactcctaaagtataccacaaatttggaaaaatacaagtgggcgcggctcagccctgggcctgggcggtgttgagccccagcaggccctggagcacggcggctaccgtctcctccagccctctcccctcccccacgtccacggtgaggtcggcgtaccgccggtagaggggttcccgggcggcgtacacgtcggccagggtctggcccggggccatggcgatgccccgggtggtgatgttgtgtatccgccgctccagctccgacagagggacgtggaggtagaccacccggcccagggccctcaggtggccgatcgcccccgcccggcagacggcgctgcctccgggggcgatgacggcgcccgtgcaggccagggagcagatggccgcctcctctgcgtccagaaagggctccacgccccggttgtccagcagctcctgtaggagggccccctcccgctgctgaatgaggaggtccacgtccacaaactgaaagcccagggccttggccagcaggacgcccacggtgctcttgcccgagccgggcatgccgatgagagtgatgttattcaatctgatttgctcctttttacacggttccgaccgcgccccagggcagctccaggggaatctgatggacggcagagggggtgctgctgtccggctccccctcgtacaaagccagcacggccccgccggaggcatcctcggggacaaagaagatcatctggccgtacagggggtcctcccactgggcgtcggagagggtgaccagatatacccccgcgtccttgagctgccgggccagggaggcgtcgtcctccgccagaagggcggtgccgtcctccagccgcagctcggcgggaaaaaaggtcaggtcgtcccggcgctcgcccccctccacccagagatccacggccaggcagcggaagccctcccgccgggccaggggtacgtaggtcagatccacctcccaggggtcctccacggtcacctgctgggtaccgtgaatggaaaagggctcccaaagggcgtgagtcccgccggcgggctccgcctgggcaaccgcccccggctctgggcggcggcccgcaaaggcttcggacaggttaagcataagacccaacacgaagggcaggacaatgcagaggaggaacagcgacacgagcacgagcaccagaagcttgagcggggagcgctgcctccgtgcggggggctcctcccagggcgtccctccctgggggccgccgtaggacaccgtccgggggcccaccggtggggtcttgggctgggccgccgggcgcggccggtccttggaagcggccgaaacgcgggcgggcggagcctgcgccgggcgggcccctgcgcggtccggcgggggattgtagctgccgcacttgggacagaagtcgtcgctgtcgtagtcgtagggccggccgcaactcgcacaggtcaccttccgcatgaaaatgcccccttctcggattttccttagagttaattccattataacagaaagcaggcccggcggcaaccgtcctccggccatgaccaaggcttcataccgcacttgacggccgacagtggtttcttataccataaagcggtacggaatggtataatggagccagactttgcgccatctgtaccggtcgcaggccggagaaacagccatgagaaagagaggacatttatccatgaccaaccgcttggaccgcgacttccacctgccggggctgctgcgctttgccctgcccaccattattatgatgctggtggtcagcctctacaccatcgtggacggggtgctgattgcccgcctggtgggagagaacgccctggccgccgccaatgtggcctatcctgccatcagctttaccctggccatggggatcatgctgggcaccggcggctccgccgtggtggcccacaagatgggggctggatatctggaggaggcccggagggacttcggctttctggccctggtggcggtgtgcatcggcctggcggtctgcctggcgggggccctgttcgccgggccgctggcccggctgctgggggccagcgatctgctgctggacgatacggtcacctatctgcgggtgcagctctgctttgcacccatggccatgctccagctcctctttgagagcttctttgtcactgccgggcggcccggcctgggcctggggctggcgactgcggcgggcgtcaccaacgccgtgctggactatctctatatggggcctatgcagatgggcatactgggcgctgccctgggcactgttacgggctactcgattcccgccgtggcgggggtgctctttttcctgctccgccggcaggggctccgctttggccgcccccacggggatctgcgcatgctgggccgggcctgcttcaacggcgcgtccgagatggtgacgaacctgtccatggcggtgactacctttctctttaacgctattatgatggcctacctgggggaggcgggcgtgtccgccatcaccatcgtgctctatgcccagttccttctggtggccctgtatatgggcttctccatgggggtggccccggtgttcagcttcaaccggggggcggggcggtatgaccggatgcggcgtattttcggctactgcctgcggtttatcctggtttcgtccgtggctattctggcggtggccctggccctgtccggggtggtggtggggatcttctccacacccggctctccggtgtacgccatcgccctggacggctttcgacggtttgcccccgctttcctctttgccggggtaaatatcttctcctccgccctctttaccgccctgtccgatgggcgcacctccgccattatctcgtttgcccgcaccttcggcttcctgctgctggggctgcttctgctgccccggctgctggaggtggacggcgtgtggctggccgtgccgctggcggagctgctctcctgcctgctgtcggtctggttcctccgccgcaagcgggccgacttcggcttcggcggtggggatctcccccgacacggtggacgcggcggcggacggatctgacggaagcgaagccattataaaagcccccggcgcaacgcgccgggggcctctcattgtactttttagaaggtaataatgccctttttcagaatcttgcggtccagcagcttctggtaggcctccacggcctggtcaaaggtgaagtagtcggaaataaagtccttaatgttcagctcaccggagcgcatccactctaccacctgggcgtgggcctcgccttcctcgcgcttgcggggcatctgctggtaaatgacgcgccagttgtagtcggcagggctgaagtcgatggtgacctcctccttttcgggcacgccgtagcacagcactgagccacggtccttgataagccccatgccctggtttacaatggcgggggaaccggccgcgtccagcacgtagtccacaccgccggggaagagcttgcgcacctcggcgcgcacatcgcactccttgctgttaatgaggtgagtagcgccgtaattcctggcctgctccagtttttcgggcaggatgtcgcaggccaccagatcctttacacccagcaggctcataaacttcaggtatgtaagacccacagggccgcagccaaacactaccacggagtcctggggctggataccgaaatagcggatgttggagagcacctcacggaaggtgacgatcatagtggcgtccacggggtccagatcgtcgtccagcaccgtctgagcaaaggcgcagtcgggagcgccgccgggccagggggctttgggatcgcacaccacagcgtactcactcaacgcgccccagccggagcccagcccaggcaggttttccgggtcaggatccacaaagggtagcagcaccttgtcgcccactttaaggcctttgaccttggagcccacctccacgacttcgcccacgccctcatggcccagcataatggggtagaccgattcggggaagcccttaaaggtgcggtggatgagcttgatgtcggtaccgcacatgccgcaggcaatggtcttaaccagcgcctgatactcgttgtaccggggcttgttgacctcgtgaacggtaatcctgccatctctctcgacgaccagcgttttcataaaaaaggccctcctttaatgaatatcgtaatattggaatgtcactacataacaagataaaaaacaaagcagcatgtatttacaagagagatcataacacaaagcatttaaaaatgcaactaaattggatgcaaaaataaaatgagttttatacatatttccatggaaaaggaaggaaataagcggtatgatactgcatatattatgatacaaaaacggttcctattacgcttgtgtgcagaatcaataatttggacagtgaaaaaacgtaaattatgcaccaatttataaaagctatattgacaagtttaaaatttgagctatactaagggcaacgatatgttactacatagtatcaatgcaacgcagtccggcgcaaaccggataccataaacacaaagtcggccgcggacaacggccgttttgtaagcaaggcaacccaatacaagaaggaggaacacccgaatgaagaagaagaaactcattgcaacggtcctctccgcatccatgctggtcggactgctggccggctgcggcagcagcacagatccggctgaaagccccactggcggcggtgaaaccaccccggctcagggcgagaccactcccgcccagaacgacgtagactatgccaattttgtgatcgatcccgcccagatcccacaggaaaagctggacaccaccctgtacctggccgtctctgtccgcggtctggagaacccgtacatcgccacgatcaacgagggcatgaagctctttgccgaatatctggattccatcggtcagaagtatgagatgcaggtgctggattcccagggcgacagcgccaaggaagtcgacaacatgcgccagtttgcggccaaggccaacggcaacgccattgcctacgccgatcccaacgaggacaccattgcctactccctggctgaagccatggcggagtccggcggctatctgggcacggcctggaacaagcccgccgatgtgggcccctccgatctggaccccaactgggtgatccacacctcccccgacaacgtggtgaacggctacaatatcgccaaggccctgttcgactccatgggcggcgagggccagatcttcgtggtgcagggcctgctgggcaacaccgcgtccaacgcccgttatgagggccttcagaaggctctggaggagtatcccaacattgaggtcgtggcggacgacacggccaactggaacaccgacgaggctctggctctggtcgaaacctggctgacccagtaccccgacgtgggcggcatctggtgcgccaacgacaatatggccactggagccctgcaggcgctggacgcggcgggcctgaagggtaaggttggcgtgtgcggcattgacgccaacaccgatattgtggaggccattgccaacggcgaggccaccgctaccgtctcctccaatggatacctccagggcggctataccctggccatctgctacgcggcctgggccggcctgctggaccccgccgcgctgcccgccgacttccgcgagtttgccacccccactgtgctgattgacagccccgaggccgcaaaggattggcagaactacaagccggagtttgacttcagccgtccctttgactgccgcgtggccgggtgaccggccggagcaccaatcctgaataacggatagtcagaacggccggggctgggatcgtggtcccagccccggcttcatattaagtctcgccgtcagagatcgctgccgtggtgtgagggagtggtccgtcctagagcgaaattggagcgacgattatgatgaaattaaatcctgcggcgaccatcacggaagagttcgccgaacgcatcaagagtgaaaaccgcagcgcaaaaatgatgaagctggcaccgttgatcgtgctggcctgtcttgtggttgtctttctcattgtctgtggggccagcttcctctcccccaagaatattatgaatattctcaaccagatggccctgcccctggtagtggccctgggactgacctttgtcattatgctgggcagcattgatctgtccattgacggaagcgtgggcatggcgggctccctgtttgcctgctttgtcctcaacagtgaatttgcgtacgatctgggtttcctcagcgtggttattgcggtaggtgtgagcatgctctgcggtctgctcatcggcctgtgccacgtctacctcaaaatcccctccttcatggcctcctttgcctttatgtacatctgcaagggcatcggtatggtctcttaccaggggcatcctcccacgatcaaggaccccgttattacggctctgcctaccaccaccttcctgggcatcccctttatcacctgggttgccattgtgatgttcctgctgtgcttttttattcaggagtataccgccttcggccggcatatttacgccgtgggcaccaatgagaacattccgcgctccgtgggcgtcagcgtggaaaaagtcaaaatcggcgtgtttaccctggccggtttcctgttcggcgtggcgggcgtcatcggcgctatccgcctgggccagggccagatcgccatcggcgacgacaagatgtttcccgcccaggcggccgtggtggtcggcggcacttcgctggccggcggcaagggcggcgtggtcaacaccattgttggcgtgctgattatgacggtgctggataacggcttggtcatgctgaacgtcaacccaaacatccgcaccggcgtccagggtgtcatcatcctggtggccgtcatcctgactgcggcccgcggcgccaaggtcatcagcaaataagggggcgggcagaatgagtgaactggaacgcaagaacggcccctccgcagtggcggagaccgtgaccaaggacggccgccggattggaacggaggtcctcttcagcgccaaggacatcaccaagacctttggcggcacccaggccctgaagggagtggagcttgagatccaccccggcgagatcgtgggcctggtgggcgagaacggcgcgggcaagtccaccctgctgaagatcattatcggcgcccaaccccagacctctggtaccatgagcttccacggcgccccctatgaacccaagacccccatggacgccaacaaggcgggcgtgggcatggtctttcaggagcagtccctgattgttaccctgaacgtggcccagaacattttctttggccatgaaaaggacttcaggaaggccggcgtcatcaactgggccaagatgaaccgggcggccgccgaggttctggccgcggtggacatcaccaacatcagccccaccaaaaaggtcagcgatctgaactttgccacccgccagatggtggagatcgccaaggttatgaacgtcaccaagcagtccggcagcgaacactgtctgatcctgctggacgagcccacttccgtgctcaacgaggctgaggtggaaaacctctacaagcagatgcgcaagatcgcggcccagggccatgcggtcatctttgtctcccaccacctcaacgagattctggaggtcaccgaccgcatctatgtctataaggacggcaccagcgtgggcagcctggacaccagggacgccgacgaggccaagctgtacgaaatgatggtgggccagtccaccaccacggagtactaccatctggaccgccagaccgcaccccaggatgatgtacttctggaggccaaagacctgggcctgcacggaatcttcaagcatgtcaacttccagcttcaccggggagaggtgctgggcctgtgcggcgtggtgggctccggcgcggaagaggtgtgcgaggtgctctgcggcgacgagaagccctccttcggggaaatctcggtccgcggcagggccgtccgcttccgctcgcccaagcaggcgctgagggagggcatccttatgatcccaaaggagcgcctgtttgagggcatcgtctctaccctgtcggtggaggataacattgccctgtccaacgccaagcagatggccaagggaccctttgtttcgggcgcggcggtgcgcaggcaggccaagcactggatcggcgagctgcggatcaagacccccgggccccaggcgctgctgcgccagctttccggcggcaaccagcagaaggtggtattctcccgggccctggccagcggtgcggacatcctgctgctcaaccaccccacccgcggcgtcgatgtgggcgccaaggaggagatctacgccctgatccgcgacatgacggatgagggcaaggctgtaatcgtactgggcgatacaacagacgaatgtatcggcttgtgttcccgcctgctcgtcatgaaggacggcctggtcaccggcgaatttgacgcccccgccgaccacaagccctcccaggttgacgtggtcagcctgatgatgtaaggaggaatcgagctatgaagacaaaaactcccaatgtgtccggcaggagtgcatggctgcgggacaacatcacaaaatacttcagcttttcggccatcattattctgctggtagccctctccctgacccaggacaacttcctgggcaccagcaacctcaaaaacctgctgcgcgacacggcgcctctgatgattatgtccgcaggcatgacaatggtgcttctgttcggctccattgacctgtccatgggcgcggtgtgctccgtatccaacgtgacctacatccacctgaagctggccttccaggacagcttcagcaatcctctcctcaccagcctggcggccatggcggtctctctggcgtttggcctggcctccggtctggcgctgggcatcattcacgtcaagctgaaggtaccctccttcatcgcctccctgggctttatgtccctatggcagtcggtggccctcctcatcacgcagaaccccgagtcggtgcccaaagccctgtggggcaccgtggagtggtacaagatcgccttcggtgtggtgggcctgcccctgattgtggcaatcgccattatcctgttcatccactgtgttacccgttacacccccagcggacggaccatttttgccatcggcggcaacgagcgcactgcccgggtggccggtatgggcgtggataggacaaagattctggtatttgccatcaacggtgtgctggccgctctggccggtatcttcctggcggccaacctccgctccagcgcccccaccatcggcgacccctttaccctaaagattgtggcggcctgcgccctgggcggcacctcgctggccggcggcaagggcagcgagctgggcaccatcctgggcgtgtttaccgtggccatcattgaaaacggcatgaactttatcggtgtcaacgcctactatcagaacattgtctttggtatctttgtgttggcggccatcgcccttacggtggaccgcagcatccgcggccagatcgtcaagtaagaaagaaggagtgcctcttatgtccgatgtaaaaccgtttgtgctggactttgaccttgtaagcggcttctgcacgagcggcaaggtcaagcctacccagcgcagagtgtccgacatggtcgcccagtttgccaatgaggcggcggcccgggccatggtggaggggggcgaccccctgctgtatgagttctacggcctggatctgcccgaagacgactccggcgtgctccagttcggcaccaccatcctctaccccggaaaggtgggggaggagtatttcatgaccaagggccactttcacaccatcctggacacctccgagatctactacggcctcagcggccacggcatgatgctgatggagacccccgagggccaggtggactggaaggagatcggccccggcgaggccctctacgtccccggacgctgggcccaccgcagcatcaacaccggcaccgagcctctggtgatgttcttcgtctaccggggggacgccggccacgactacggcaccatcgaggagaagggctaccggaagctggtggtggagcgggacggaaggcccgccgtcatcgacaaccccaaatggaaggtgtagccccaccctttgcggccgtcctgtttgatctggacggcgtcctgcgcaacaccgagccataccaccgcatggcctatgcacagctggcccgcagcctgtccgggggcgcgcccccggacgccggagagatcgcgggtaagtccaaccttcagctctatgaggctctggtggcccgcttcggcgggccggccacggcggaggagctgtcccagcggcacttccggctggtctgccagctgctggaggagtaccgggtggggccgatgcccggcctggaggaggctctggacgccctgcgccgccggggcattccctttggggtggtgtcctcctcctggcgctggtacgtggagcattgcctgcgggagttggggatgtatgaggacgccgcggtgatcgtcaccggcagcgacggcctgcccctcaagcccgcccccgccccttatcaggcggcggcccgggtctttcgccctgccccgcccggcgcggtgctggccgtggaggacagcggcagcggcgtccgctccgccgtggcggcgggtctggcctgcgcggcggtatacaaccccgactcgggggcgcaggatctgtccccggcccggtggcggctgaacagcctgtacgagctgcccgccctgctggacggcaactaaaccaatccgatttttgtttacataataaggaggtcatttccatgtccatgctgcagcattccacccgcgcctggggctcccccagccgctacatccagggccgctatgagctggagaacatgaaaacccacaccgaggtctacggccgcagggtgttcttcctcattgacgtgttcttcttcgccgactacaagaagcgcttcgaggccctgtacgccggcagcgacagccagatccagtgcgagcagttcggcggccagtgcaccgaggaggagatcctccgctgcaccggcctggccaaggccctgaaccccgacgtggtggtgggcatcggcggcggcaagaccatggacaccgcaaaggctgtggccgacaactacaacgcggcggtgatcatcgtccccaccaccgcctccaccgacgctcccgccatgggcctgtccgtcatctacaccgccgcgggcgagcacgtgggcgcccgccactacaagaagaaccccgatctggtgctgctggacaccgacattctggccaaggcgcccatccgcttcctggtggccggcatgggcgacgccctgtccacctacccggagtgccgggccaacgtgcagtccgcctcccccaactacgtcaacagcggctatcaccagaccatcgcctgcatcgccgtgtccaaggcgtgccacgagaccatcctgaccaagggcgtcagcgccaagctggccgccgagcagggcctgtgcaccaaggacgtggaggacgtcatcgaggccaacaccctgctgtccggcctgggcgtgcagaacggctcctgcgcgggcgctcactccatcgccgagggcatcaccgtcctggagccctgcgccaagctgctgcacggcgaagtggtggccttcggcatcctggtgcagctcatcgtggagggcgcccccgccgaggagcttgacgagctgtacaccttcttcgaggaagtgggcctgcccaccacctttgacgatctgggcattcccgacgccaccgaggccgacatcaggaaggtggccgagacctccatgcactcctactgggacgtggagcccttcgccgtcaacccgcagatggtctttgacggcatcatgatggccaacaccctgggcaagcgccgcaagggcctgtaagcgggccgcggccggacggaaaggaagcgcacgcatgaaagccattcaatacaccgccccccggcagtttgccgtggtagatctgcccaagccggagcccggcccccaccaggtggtcatccgggtcaaggcctgcggcatctgcaagaccgacctgaccatccacgacggaagctttctggccaagttccccctggtgaacggccacgagttcgccggcgtgatcgactcggtgggcagcgccgtcaccaagtggaaggtgggcgaccgggtcaccgccgacaacactgagctgtgcggctactgcgagccgtgccgcagcgacaagcccctgtactgcgagaacttcaactcccacggctgcaacatgcccggcggctttgccgagtatgtgctcatcaaccacgacaaggtgttcgccctcagcgacaagctgtcctttgaggaggccacctttaccgagcccaccgcctgcgcggtccacggcgtggaccgcatcgccccccgcttcggcgactccatcctcatgttcggcgcaggccccaccggcatcatcctggcccagctgctccgccgggcgggggcgggccgcatggtcatcgccgatccccacgccgacaagctggacattctgcgcaagtatggctttaccgacctggtggtcatggacaaggccgacccgtccaagcacaccgccgagatcaaggccatcatgcccaagggcttcgacattgtcatcgacgccaccggggccgcctcggtgttcgagtcctgcttccactttgtccacatgggcagcaagattgtggcctacggcgtctgcgccgccgacgccaaggtacccgtcagcccctacgacattttcagccaggagtacaccatcctcggctccttcgcccagacccactgctttggccgggcgctggagtatctggagagcggcgcggtgcaggtcaaggagttgatctcccacgagctgccgctggaggactacggcaagggcctggactacatcgtccagaagcaggcccgcaaggttatcattcacccctgagagcgcctcctctccgtgtgccgaaaaaagcccgcccgccccggcttggggtgggcgggcttttatgtttctcgctagggctccacgtccagcatcgccatggtggcgggcatttcgtgggcggtattgaccttctcctcgtcggtgaccagatcgaagcaggagacgatgatcttgtccccccagacgcacggctcgcccggctcgtccagctcgccgtggaagccgtcggtgtcgggggagcaggccatccgcgtcacccggccgtcgggggtgatgcgggcgatggcgttggccgagaagtcggccacgtagatgttgccgtagggatcgatggtcatgccgtcggtggacttcaggttggccggatcacaggcccacttgcggttctccttcaccgagccgtcggggttgaaggtgattttgtgcaccaccccgtcgccgaagttgccgacgtagaggttgccgtcgtggtcgaacacgatgccgtccacgccgtactggcacttggggttctcggtgataaaggtgaggaagatgtggggatcggccagggtgttggtgcagtggatgccctcggcgtccagggggaagcggtagacacagctcatgagcttgccgctgtccgtcttctggcgggtcatgcagctctgggtgacgtacatgtagtccccccagatgcggatgccgttggggtgctccatgttgtcagccaccacggtgcacttcaccacccccgcgtcgttgagccgcaggcggaggatgcgcccggtgaacaccatgtggggctctccggtccagcccgcgttgtccaccagatagaggtcgccgtcggggccgaactcgatgcccatggcccgggcctcaccggtgtactcgttgcgcggcacgtcaaaccacttcttgatgttgcggtccttgtcgattttcagcacgcagctgggcatggacagatccgcaaagttgggacaggacagaatcaggttgccgtccctgtcgatggccatgccgtcgggggtgcacaccagctcctccggcagcagggtgaacagcttggatgtctgcataaagcgcattgcctccttttacgcggtcagctccttgaggaaccggcaggcccggcccgccatctcgtccagcccggcctccccggccccgccgctgagatcccgccagaccttgatatcatagggaatggtaccccccatgagcacgaagggctccatcacaatggccccctggtagttcacctgcttgagggcggcggccatgtccttccagggcaggcggttggtggagccggcggggcggcggttgttctcccccacgtggaaatgccccagccaggggcccgcctccagaatggcgtccaccatgctgtcctcctcgatgttcatgtggaaggtgtccagcagcacccgggcgttgggactgcccaggcgcttgacaaactccacaccctctttggcggtgttgagcaggtactgctcgaagcggttgaccacctcgcagcagtagagcacgccgcagttctccgccaccttcatgagccgggacatggactccagggcaagctcctccttgcggcgcttctcatccagggtgattccgtggtcgggcagggcctgccacccggcgtaggacacgccgttgaggatggtcgcccccaccttgggcatgctctccaggatgcgggtgacatggcggatgccgttctcccgcaccgccgggtcgtcgctggccaggtcgtatttggcctccaggccgatggaataggtgatgcccaggccgttgtgatcggcgcaggccttcagctcccgcagcctggcgtcgtcgtaatagccccactcggcggaggccacctcgcagatgtcaaagcccagccaggccagcttctccatcaggggtatgtatgcaatctcgtcccagttgtggctccagaagccgtagtgcattccaatcgggttcatggcgcgcctcactggccccgggcagcgcgaatcttctccacaaactggcgggcggtctcggtaatcttgccgtagtcgccggtcttggccccggcggtcaggctgccgcccgcgcccacggccaccgcgccggccgcaatccactcggccacgttgtccagagacacgccgccggtgggcatcagctcggcctgggggatggggccgtggatggacttgagaatcttcggcccgaacagctcgccggggaacaccttgatgatgtccgcacccgcctccatgccggccaccacctcggcgatgctcatggcgccgggcatgcaggccacgcggtagcggttgcacaggcggacggtgtcgccgttgaagtaggggctgaccacatactgggcgccggagaggatggccatgcgggcggtctcggggtccatgacggtgcccgcgccgatgacaaagtcggtgccgtcatactctctggccatcttctcaatgatggcgttgacgccgggggtggtgtaggtcagctcgatgccggcgcagccgccctcgatgcaggcctcggcgatgcgcatggcgtcgtcggcgtccttggcgcggaccacggccaccaggccgcaggagcgaagcttggcaagtacctgttcctttttcatgggaaaaacctccttacgcattcttgtgggacgccatatactcgtagacgggcagcatggccttgtagcacacctcaaatgcctccttcaccgggccgtaggcggccacggcttcggggtcgggctccaccgtgcggttgagctcgagcatctggtcgatgacctcaaagcccttgaacacccccacgcccacgccgccggtgaccgcggcgcccatggaggtggcctcctccagcaggacgggcaccttgatgcgggcgttgtagacgtcggccatcatctggcaccagagggcgccctttgcgccgccgcccaccaccagcagctcgtcgatggggatgctccggcggaaggactccaggataatgttcaggttgagggtgaccccctccagtacggcccggaagaggtcgcagcgctggttctccattttcagccccagccaggcggccgtggcatccgggttccagcggggggcccgctcccccagcagatagggcaggaaaaggacgccgttggcgcctacggggctctttgccgcctccgcgttgatgagatcgtaggggctgatgccctgcactttggccacggcggtctcatatttggccacctggcccttgagccagttgtaggaactgccgccggcctgcatggtgccggtgggcgagtgcagcccggggacgatgtgggcccaggtgaaggtgcgcatctcctcgtcaaagaggggcttctcgctggtggtggccacccaggcggaggtgccgatgcagctaaaggtgcggcccgggctgatggagccggcgcccacgttggagcacaggccgtcgccgccgcccatgaccaccggcgtgcccgccttcaggccggtctgcccggcggcccagggggtgacctccccggccacggtggtggaggggacgatctcaggcagcttgtcgccgtcgatgcccgaggcgttgacgatcttgtccgaccactggagggtgttcagatcaatgcaggcgttggaggtggcgtcggagggctcggtataaaacttccccgtcaggcgcaggacaatgaagtctttggcgttgagggccttgtaggtcttggcatacacccccggctcgttgtcccgcacccacatgagcttttgcaggccgtaggaggcgctgttgcggtgcccggcgatgtggtagaagtcccgcagggagatctgctcccccagggcggcggcctgggcctgggcccgctggtcggcccagatgatggagggccgcagggggttgccctgcttatccacgcacaggcaccccatcatctggccggagaaggagactgcggcgatgtcgccggggtcgatgcgggccttgtcaatcaggttgcggctggtgacgcagatggccttccagaaatcctcgggatcctgctcggcccagttggtgttgaagtagtggcagtcgtagcggaacacctcgctggtgatcattttcccctcgtcgctgaacagggttgccttgttgccggaggtgcccagatcgtgggccagtatgtatttcatcgctgtcctcccgccctacaggcccagatcgtggatgaggttggcagtagccatgcgccccatgttgcgggacgcgcccgccgtggaggcggcgcagtgggagccgagcaccacgttgtccagggtaaaccagcggggatccttgggcggctcggaggagaaggcatcgatgcccgcgccgcagaggcggcccgcctccagcgcgtccagcagggcgttttcatcaatgaggccgccccgggcggtgttgatcaggatggcgtccggcttcattttggccagctccgccgcgccgatgaagttctccgtctccggcgtcaggggcaggtggagggagatgacgtcgcactcggcgaaaatctcgtcgggggcggcgcgggtgatgccgtgggccttggcgtacgcctcgtcccagaaggggtcgtgggccagcaccttcatgccgaagccctgggcccgctgggccacgttgcggccgatggcccccaggcccaggatgccgatggtgccgccggtcacgtcccgggtggtgatcttcttccagtcgccctggcggcagtgctggtcaatgagcaccgtcttgcgggccaccgccaggagcagggccatggcgtagtccgccaccgcctcagcgttggcgcccaccgtgcgggagaccttgatatcccgggccttggcggcgtccagatcaatgttgtccacccccacgccgtatttggcgatggccttgagcttaggggcggcggcgatcacctcggcgtctatgggatccactcccacgatcacgccgtcgcagtcggccagcagggccttcatgccctccttgtccaggatcccgcccgtctcattgcgcaccacctccaggccggcggcccggagcatggcaaagacctcgggatcggttttcccgtaagaacggggtgtggtaagtaccttcatgacagagccctccccttggcgtcactttctcatttcccgggccagccggtcgcaggcggccagccgctctccggtgatgtcgatgtggaagacctcggcgatcacctgggtccagccatggataaagtatgtccagccgtcctcaatcagaagcccccggcgctcccgctgggcctccgcctggtgcatgaactccagggtgcctcggtagttgagctcccacaccaggccgttctcggggaatttgcagtggtcggtgaggggggagccgggccggtccttgcccagcccggtggcgttgatgaccagggagccggcgggcagggcctctacaatcctgtcgttgagctcgggggtcttgcacagatggtagctcatggggacgttcaggtactccaggatgcgcacgccttcggccaggcggggggcggagcggttgttcaggtggatgcggctgggcagatccttgccgtgccgctcctcattgcccaggtaggcggagatggacagggcggagccgccggcgccgatgatgcacacctccgcgccggtcttaagccagtggccctcgggcacgaaggcgtccagggccaggccggaggagatggggtccttggcgtgggcgcggagctggccgtccagcttggagatggaggacagctccccgaagcgctgggcataggggtccaggtagtcgaacatatcctttgcggcgttatacatgtcaattttgtgtgtggtcaccagcgcgcccagggacagggggtcatcccggaagaactgcaccaccgcccggtagtcctcggcgggggcgtggatgggcaggtcgatgcccttgatctccgcgtccagccccagctccttggcccagatggggaacattttcatgatggaggactgtccggtggtgacgcccacaaagtacatggtgggccgtttggcgggttcggggagtttgatcatggtcaggcgcatcctttcttgactgatttggtattgaaataccggtcagccggcgaagagccgccggcaattgagcacggtgaaatccgcaagggttccgggggggaagccggccgcctccagccggggcagaaagcgctccagcaggtagcacaggctgatctcgccgccgtaggcggccatgcgctgggcggtggtgtccagagacaggagcagcctctgggtgtacccccgctcacacatgtgccgcagcagcgccacctcctcctcgtcggagtggtacttgaagcggccgatggtgtcgtagtccaggtacacgccggtggcggcgatggcgtcatgggggccgaagtcggcggcctgccggtccacgtggcagacgatgagccgttccggcgtcaggcccgcccgaaagcagagctccagggcgggcagggtattctccccccgctccgtgtggagcatcagcggcaccccgcagcgcaccgccgcccgggcggccgcccgcagcaaaacggcgtaccggccctcggcgccttcggccggaatggcggcctttaccaggcccgcccgaaaggccgtcggctgcgccgggcggcggtccggctcgggccgccaggggagcatgccctccagcagctcaccgcagtagaggtcgtacaggccctcctcatccaggctgtggacccagcagtccgccgggtaaaagcccagcagatggtagccggtagaggccgccaccgccacgccgctctcccgcgacagcgcgccgaggcgctctgcatcccgtcctgcggccacgggctgggcgtccgccaggaagcctccccccgccgcccggtaggcgcgcagctcctccagtgaacgagccgggtcgtccagccggagggcgggatttttctccgccatgggcgtccggtggacaaagatgtgttcatggatctggctgtgccccagcgcgtccggtgcgatggggccgctgacggtttgcacatggaacatgacctgacctcctgataaagtatcgtaggattgtaactatgttactacataaaaggggaagcaaattccgcgcgtgcactcactcgcggaacagctcgacacggaaccggctctggtcgccccggtagtgggcaaaggagagctcaatcagcttgccgctctggttatagccgatggtctggaaatagtgaaccgggcggccccgcttcaagcccagaaccgcggcgtcctccgggtcggcggcccgggcctcgcagatacgggtgacgtgggtgacccgggtgtcgtcccgcttggacagcacctgatagagggactcccggttaaagtcgtgtcccaggataaagctgcacgcttcatagggcaggtaggtctccacccggacgatgggctcgtcgtcggcaaaccgcttgcggtagagatagatggccttggtgcccgcgggcagctccataagctgcgccacctcgggctccagctccaccagcttgagatccagtacctcggtgctgggggtacggccggtgctgcgtacgtcgtcgtcaaaggactggatgctctgaatgaagccctgtaccagcttggggtgggccacaaaggtgcccttgctcttgatgcggtacaggtgctcctcccgcaccaggtcggagatggcctggcgcacggtggtacggctgatgccgaacatctggctgagctccatttcggtgggaatcatgctccccaccgggtaatttccgttgtcgatctcctccaggatcagcttttcaagctggaaatacaggggaataggcacatccttatccagtctcttgtcttccagcatggcacgatcccttcctctctttttacagtcattgctttaactagattggattgttgtaacatatatacattatagtctataaaggggccccttggcaagggggtcaggcaaattctctaattttgcacaaagaaatgagtcagatatcgccgaactgaccagtcgcagccagacgctgcgcggcctacagcctctggctgaactccaccgtctctccgttggggcccagtaggttgaaaaagcgcacgccgttctcccagaaggggaggaactgaatggcatcttccaacggggccaggccggccatccgcacttcctcccaggcggactcaatgtcgtccacgtccagggccaggtggtcgatggctccgggccggcgggcgggcgcggcgcactcgtaggtttcgatgcacaggccgccgcaggtgagaaagcacacccgctcccccgtgccgggattgacagtgctgtgggcccggacaaagccaagggactcataaaaagcggcggtctcgtccagcgcggcggtgggaagccccaggtgctgtaggccggttacatgctctgcaatgctcacggagctcccctcctcagtcgtcgctggggtccacgtcgatgaggaccttcatggtggtttcctggtgcgtatcgatgtactcgtaagcggccagatagtcggtaaaggcaaaatgcctgctcatcaggggctggagctgtaccatgccctcgcgtacaaagcggatggcatccacatagtcctcgtggcgatacatcatggtggtgttcagatccagttcggagtcgttgagcttggccagatcacagtgggccaggccagcgtacaccgcaaccaagatgatgacgcttcccttccgggcgttctggatggcctgatccatggtggtgtcattgcccgcgcagtcgtagatgatgtccgccttgtcggggccgaagcactccgtcagagccgcgccaaaggggcgggttttggtgttgacagcgtaatccgctccgcaggtgcgggccagctccagccgatagtcggagatatcggtggccatgacctcggccgcgccaaaggccttcagggattgaaccagcagaatgccgatagggccgcagcccagcacgcataccttcttgcccgctacgtcccccgcccgcctggcggcgtgcaccgtgacggccagaggctccagcatggcgccctcgtcatagctcattcccgcaggcagcgccgtcacctttgaggcgtccaccgcgaagtattcactggcagttccggtggtctgaaagcccataaccttcaggttctcgcagaggttatacttgccgtgggtgcaggggtagcattcgccgcagtacacctggggttcaatggtcacccgctgacccacctggaattgggtgactccctcccccagcgccgcgacctggccggagacctcgtggccctgggtgaccgggtacttggtgtaggggtgcttgccgtggtatacgtggatgtcggagccgcagatgccgatgcgcttgattttcaccagcacctgcccgggcccggccgtgggaacgggcaccctgtcaaaccggatctccctgggggccgtcatcacttcctgcagcatggtttcttgcatcatactcacactcctttgtttggtcccgtccggtgtgcagggaggccggacgggtaaaatccatctatatcatgcgagtatgggaggggaaagtcaagaggattttcgtgaaaaatgcacagaacatcaggtaaaatcagcaccccgccggggagagagcaggggcactccggcttacccggagagcccctgctctggaatcagccctctgtgacgccgataaagccgccgccggtggtgtaaatcttatcaatgaccacctcggctggatccccagaggtgggaaccgggtcggcgggggcctcgggggcggtcagatccaccaccacggcccccttgggaggctcggtttcaggggcggtcttgccctcggtgtaccggccggacatggagaattccaagtccatcagaccggcggcatcacactgcatagaggcctccatcctgccgtcggcgtccatggactcctggagggagatggacatgggagcggaaccgtcgacatcggcggagagctctacggacaggtcataggcggatacgtcatcaccccgcatggtgagggtgaaggtgaagtcggcggccacgccgtcctgctccagggcgtagtgaaggatgcggtcgttcccgctgaccgcccaggcgtcgtcccgcaggagctgggcggccaaatctacggcctgggtcagctcggaataggcggtgtccttgtcattgggctccacggtggagagaagcagggacagcagggcggtatagtccacgtcgccggtggtcatctccatgagggcaccgtagtccaaccccatgtcctcatatatggcactcatatccatagagtaccaggtgtcggcgggcaggccggcggcctgctccaaaaatgctccgcccaggctgatatagagctgtccggcctccagatcgccccggagctccatatggataccttcctcggcaagggcatccaacaactcggtatcgctggcgctcatacctccgttctggccatccgtcagagccttcaggaaggggcgcaggtccatagtcaggcccatagcggcgtccatcttcgcgccgccggccatgacgccctccagagtgccgtccagggtaatgggcgcagattccgccgtacttcccagaagaaggcccgtcatgtccagagaggcgtcaaagtcggcgttcatgtcccagattcccgtgcggtacttctggccgtatgccaggtatttttccagataggtaaagtcatacttggatagggtctcctccaccagcttttccatgtcaatgaggatcacggtgcggtcgccgacgtcccagcccacggcgcagccaaaggcctgagcggcgaagcgtacgggcacataggtgcggttgtcgtgggcgtagggggccgcgtccatggggatgtgggtggtgacgccgctgcgctccacggtggctgttgtgccgcccagggccatggtgacggtggtgccgtcccgaacggcggtaatggtctgagcggcgggggaatagcttacctcggcccccatggcctcaaacacggtgcgcacaggcaggaaggtgcggccgtccctcgcctcaggtgcggcgtcagggaaggacagattccggccgtccagttggacggagatgccggtggatggggcggaggcggggacggactccgcggccagggcggaggtgccggtacccaatagggctgccgcacaggcgacagccagggcgcgcttgggaagtgtgtgcatgattccattcctccttttgtcggtagagccactatagcacgctttttttgcggtgacaagagagcgggagctcttcttttgaggaaaaatcaaattttttacttgacttagtcatgtttggaataatcatagcacagcccccgtgatactgtcaactgaggttacctatctttgggataaacggggtgcggagcttgaagatctacagaccgggcggacggtgcaatatatctggcgagcgggtacgccgtgcccgggagcgggcggggctgagccaggagcagctcgcagtccggctccaactggacgggctggggctgacccaaaaggccatcagccggatggagaccggggagcgggtggtggcggactatgagctggtccacctggcccgggcgctggaggttggcgttctggagctgctgggcctggagccataaaaagggggggcgttcccgcgggaacgccccccctttttggggttaggtgggcctgtgctccagctccaggcgccgcttttcgagaatgcgggggaagcgccagaagaagatagcgccggtggtggtggccgccaggatatcggccaccggctcggccagaaacacggcgaaaacctggtcgctgaggaagcggggcaggagcaggatcaggggaatcagcaggatcaccttacgcagcagggccagaaagagggagacgcgggtctggcccagcgccacgaaggtctgctggcaggagaactgcacccccagcatgaacataccggcggcatagatgtgcagcgcccagacggcaatctccaccagctccggcttgtcgttaaacagcgagacaaacaggcccggaaagagctccagcgccgcgcaggcggcgcagctaaagcacagggaggagaaaaagagcaggcgaaaggtccgcttgacccggtccaactgcccggcgccgtaattatagcccacaatgggctgggccccctgggacaggccctggaacagaagggaaaagacctgcatgatactggagcagatggtcatggcacccaccgccgggtcgcctccgtaggtcttgagggaggaattgaaggcgatgttgaccagactctcggtggactgcataatgaagggtgagagccccagggccagcaccggagccagcaccttggcatccagacggagaagccgccgctgaatccgcagcttggtgcgcctgccgcacaaaaagcgcaccacccacacggcggagacggcctgggcggtgatggtggccagagccgcgccctttacgcccatattcaggccgaagataaggatgggatcgaggacgatattgaccaccgcgccgataatcaccgaggccataccgacggtggagaagccctgggaggtgatgaagaagttcaggcccagggccagctccacaaaaatggagccgtagaggtagatattcaaatagtccatggagtaaccgatggtgttctccgtagcgccgaagaggtagagcatgggctccttgcagagctggaataccacggtggcggccaggcccaggatcatcagcagcagggtgcagttgcccagaattttgttggcctcgtccagcttcccctcccccatgcgcaccaccgcccgggagccgccccccatgcccaccagggcggagatggcggagacaaacagaatcacggggaagcagatgcccaggccggtgagggcgagatcgccctcaccggggatgtgcccgatgtagatgcggtccacgatgttgtagagggcgttgaccaactgggcggtgacggtgggcaccgccagccgcaggaggagcttgccgatgggatcgcggcccaggtcgttttcgcgctttgccatgaatcagctctcctccttttccaggaaataggtggcctccatgtcggccacgctgagggcaaaggccaggggatactgctggagggcctggcccaccagccgcttgtcctcgtcgccggagaagcccatatgccagcggatggccatggcctcctcccgggtgaggcgcaggaagccggagaggatgtagacgctcttctccccgtggccgtagggcagggggtcctcgtagaaaaaggtgggcaccgcctgccacttgccgtcggggcccttcacgttgcgggagccctgcctgtagcagcccgtcttgcacacgtcgtggagcagtgaaaccagtgcgacgctctccgccgggtactccaggccgtacagctccttcacccgctcccgctccaggtaggcggtcaggcagtggtagacattgacgctgtgctcacacaggccgcccgcgtaggccccgtggaaccgggccgaggccggggcggtgaaaaaatcgcttttgtgctccaggtagtccagcagggcgtccgccccgtcccgccggatgttctcccggtagatctcgataaattcttccttggcgctcatggagcagtctccttttctgtttgacagatagataagatccagtatagcataaactccagcgaaaagccaccctcggcacccctgtttcacacctggcataggatgggcggaataggaggagtgctatggaatggctttcgctgcttctgaccgcggtcctgtttgccgcggcctgtaatctggatactgtaattctctcgatgggctacgcggtgaagggcgtgcgggtctccctgtcccacagcctgattatcgccgccctcaccaccctgatcacctgggcctccctgctcctgggggccggggccgcccgggtgctccgcggccccctgcccaacctgctgggcgggctggtgctggcgggcatcggggcgtggttcgtgctggactggctgcgccgcctgggacccgccggggaggcggaaggggaaaaccgggccgccaccctctgggggtgcgtctccctggccgccgccctggcggtgaacaacgcgggcatcggcgtggccgccggggtgtccggcattgcccccggctgggcggccctggccaactttctggtcaccctggccgccctccccctgggccgcgccctgggggataagctggccgggcggctgctgggcaaatacgccctccccctctccggcgcgctgctggtgctgctgggcatctgggaggcggtgggataggccttgtttgaaaatagtcaacacgcccaatcgccgggccttttgccctctggacggcccaatttttccttgaaatccgccaggattcctgcgaaaaaattgcttgccagcgggcaaaattcctcgccgctggtcatattgctatttttcaaacaaggcctagccctggcgcggcgggcggagatgtggtagaatacccccgaaagaagggattgcatatgacgcttctggagcgcctggggggccgggaggccatcacccggggcatcgtacacaccttccgcatcctctcccgccgcccacggccctcccggcacgaggaggccgccggggaggagctggacgcatacctgcgggggctgggcctctcccctgtccgggacggggcgggcaaccggatggccgacgtgccccccgcgccgggccgggccagcgccccccgcctgatcctccagggccacctggacatggtgtgcgccgtccggccgggcagcggctggaaccccctcgccgacccggtaacggtgatggaggaggggggcttcctccgctcggacggccgctcctctctgggggcggacaaccacctgggcaacgcggcggcgctgtggctcctgtccaccggggcggtgaatcacgggcccctgcgcctgctcttcaccaccgccgaggaggtggggctggagggggccaaggaggtggcgcccgactggctggctagggcggagtacctgctcaacaccgacggctttcacctgggccgggcggtggtgggctcggccagcggacggcgggagacctgggccgcccccctggacgccgggccggccccggcgctccccgcctggcggctcaccctttccggcggccggggcggccactccggcgacgacatcaaccggggccgggccaacccgatcaagctgctggccgcgtttctggccgggctgcccggcgggcggatcgcctccctctccgggggcctcacccacaacgccatccccgcccaggccgaggcggtggtattctgccccgcggagcccgacctctcccccctgcgggccgccctggccggctaccgggcggccgatcccggcctgaccgtggcctgcgccccggcggagaggccggagcgggcgtggacgccggccttccaggcccacgtcctggcctttttgatggggctgtaccacggggtgtacgccatggagccggccttccccggtacggtgggggcctccgccaacctgggccgggccgggaccgagggggatgtttatggggtgtgcgccttcctgcgctccgcccggccggagtgggaggcggagctggctggccggcacatggccctgggggcggcccacgggttctccctgtccgtcaccggctaccccggctggcccggcgaccgggccaaccccctggcggcggtgctgggccgggtgtggcgggagcagaccggccggacgctggagctctccgccgtccacgtggggctggagccgtcggtgttccgggccaaggccccggggctggtcatggcctccgccgggccggacattctggacgcccactcggtggatgagcgggcacccctggacgggctgcccgattacgccctgctgctggccggggcgatggaggccctttagacgggcggccgtccacgcaatacaacagggtacaagcaagaaagtacgcgccgcccgccggagttccggcgggcggcgcacatgtttacgcgtaaatatgatccaggatatccacaatctgcgccacgcagctctcctcgcaggcgcccaggatacgggcgccccactgcttgacctcgggggcgcagttggcgggggcgaaggggatggcggagacggccagcatggggatgtcgttctggttgtcccccacgcagtagatgtgctgggcgtcgatgcccaggcggcgggctaggtactgcaccatgccgcccttgctgctccccttccgggtcagctccagcagcacccggttggagaagatcacctcgtaatgctctccccaccgctccagcaggtagcgctgggtgtgcaggagggtttcatagtcctgctggagaatgaccttgctccagggcagggggatatccgcgatgggcacctcccgggcggtcatgcccgcccgctccaggtgacggaaggtgacagcgttgggctggtagacgtagatggcgtcgtggtggtaggcctcaaagccgatggtgggaatggcccgggccatctgctggagatcctcccgcacccggtcgggcagaaaggtctcgtagatcatctcccctgtccggaagtcgtacagggcggagccgttggacagaatcaccggcgcgttgatgggtatgtggctggcgtggggggcgaagttggggcgggcgcggccggtggccacggtgaaggtacccccctcccgggtaaagtaggtcagggcctccacattttcccgggtgatgcgcatgtcctccccgtagagggtgtcgtcaaaatcgctgaccagcagcacgccgttgaatttgcccaactgattcacaccttaccttctcagatcggcccccatcatatactttttcagcggtgcatagaggatgccaaaaatcaccagacacaggacaaggtcaatcccgacatagctgccgttgtagataagggagtagagggcgggattgtcgaatactgtgccgaagatctccgtgggggccagaattttgtaaatggtgataccgctgatatagtggacaacaaagcgggcggctccgcccagcacgctgccccagaagatgccgtgaggtttgccacggcccaggccggcgatgcccatgacaccgaaggccagcacataatccagcaggatggactgccagccccagcttaccgcgccctggatgaatacctggagcacgccgaaggcaaagcaggcgatgaagccgcctcccatgccccagcgcacgcagaagaacagcaggggaagcatctccagcgagatggagccgccctggggcagctcaaataccttgagaagccccagcaccagggcaagggcaatcatgactccgccttcgcaaagcatccgcaccagcagatacataccgcggcggccaggggcttttgtggtgacaggttcagacatagagctcattcctcctaaaaaatgtaccgcagcgcaaaccggaaacagcgcaatgcggtacgggagaaacgacctctatcgtcgaatactcttcctacgccggcattacccggatcaggtttaagggacacgggcggccatacgccctgatctcagccggacttgcgtccagcacccctgcgattcgatttgttctacggttattttagagtttataccaaatggcgcagctttgtcaacacttgggtaaaataggcaggcagggggcactccacggtgacccgctccccggtgcgggggtggacaaaggagagccttctggcgtgaaggcactggcccgccaggccggggacgggcttcttggccccgtataccacgtcccccagcagggggtggccgatggaggccagatgcacccggatctggtgggtgcggccggtctccagacggcactgaatatgggtatagccggggaagcgctccaacaccgtccagtgggtcaccgccggacggccgtttttccaatccacgcacatcttcttccggtcggtggggtggcggccgatgggcgcgtccacagtgccgccgtcctcccgcaggccgcccacgcacaccgcctcgtactcccggtaaagggagtgatcctggagctgggtggccagggcctggtgggcatagtcgttcttggcggcaatgagcagccccgatgtgtcccggtcgatgcggtggacgatgccggggcggagggctccgttgattccggagagtgattcaccacagtgatataacagagcgttgacaagtgtgccgtccggatggcccgccgccgggtgaaccaccaggcccaccggcttgttgaccacaatcacgtcggcgtcctcatacgccacgtccagggggatggcctgggggagcacgtccaccggctccggctccgggaggcgcacctccagcacgtcgccctcggcggccttatagttctttttcaccgggcggccgccgagggtgaccgccccctcctccagcaggcgctgggccgccgagcgggtcagctccggcaccagccgggccaggagctggtcggcccgctcccccgcccggtcagcccgcaacagaatcggctccatggccctcctccttgccgtggaagaagaggtagtacacgcagaacgcgatgccacccaccaccacgcagatgtccgccacgttgaagacggcaaagcgcatgaacagggtctcaaacatgtcggtgacgtagcccagcagggcccggtcgatcaggttgcccaccgccccggccagcaccatggacagggcggccatggcgaaggggcggggaaagacctttttcaccagaagcaccaccagcaggacggacaccaccagggacacaatggtcagaatccaggtgtgctcctccagcagggagaaggccgcgccggtgttctgcacataggtgagatggagaatatgggggagaaaggggacgtctccccccagggggatgttggcccgcaccaggaacttgaccacctggtccagtaccaccagggccaccacgagaacggcgtataacatgggcaaagggctccttttcttcggttttgttctattttatcacggcctgccgccgggggcaacccggaagatcggatgtagattccaattgaagaaacaagaaaaatctggtatactggggcaaaaagccgaaaggtggtgagtgcgttggatgaaaggcggaccctttcgttaaatgtgttcctgaatacccttgaggagggctgtaaaaacgagcggcgctactgcttcatcctgggcgccggggcctccaagacctctggtatccccaccggggaggaactggccaaacagtggcacggggagattttggagcaatgctccaaggaggagatcaaggagctgaaaaagcggctgggggtgcgctcgaccaagccgtccagccgggcctattttgacctctatgccatgcgcttttttccggactatcagaacggctccgcttttctggagcggacgctggagcgcgcccagcccagcctgggctactatcccctggccgccctgctggccaacacgcgcaacaacctggtgatcaccaccaatttcgacagcctggtggaggacgccctgtttatctacacggataaaaggcccatcgtcatcagccacgagctgctggcccagtacatcaacttcaacaccagccggcccatcatcgccaagctccaccggggcctgttctttgaccccctcaaccgggccgagcaggtcaacggcctgtcgaagcagtggaaggatatcctgcgggaggccttcaagcgttatacccccgtggtgatcggctatgccgggggcgaccacagcctgatggactttctgaaggagaccgagtgcctgagcggcctctactggtgctaccgccacgacgagccgccggaggagattcagaaggtggtggagcgccacagcggatactttatccccattgagggctttgacgagatgatgtacctgatggggcagcggttcggctatactgacccctgcgagcatatcgaaagcgcggccgagcagcgggtgagggactatcaggagcaggtcaaggcatttcaggagaagctgcgggccgccgagacccccagcgagacccagagcgccatcctccgggccatggacgccaaacagcgggaggagcttcagcggctggaccgtcgcatcgagctggacgaggaggacggggaggcctactgggagcggggaaagctctactattttgccaacgactatgcccaggcgctggaggacttcacgaaagccaaagagttgggaatggaggacagcaagctctactggtataaggggttttgctacagaaggttgggagaaacagagctggcaatccgggaatacagccgatcgctggaactaaaggagacttcggaggtgtaccgcaatcggggcctgtgctttaccactgtgaagctgtatgacaaagctgtccttgacttcaccagggcaatcaaactgccaccgggggacaagaggctttacagggagcggggcagcgcttaccaagctctggaggagtataaaaaggcccaggccgattatgagaaggcgctggagctggaaccggccgatgcggagctctatacgaccttgggagatgtgcaggaaaggcttggagaggtgcaggaggccctgcagagctaccaaaaggccatccagatcgaccctaattatgcaagagcctataacaaccggggggttgtatacttgtcccagatggagacagaaaaggcgctggccgatcaccgaaaggcggtcaaactcgcgggagatagggcgctttatcatgtgaacgtgggaattgttctcaacaggctggagcgatacagcgaggcggtcacaagctgtaacaaggccatcaagctggatccagggtacgccaaggcatacgacatccgtgccgatgcctatgagggtctggagcagacagagaaggccgaacgggattgggagacctaccgcagcctgacgaaaaaaacggaagaagaggaggacacgccgcaggcatagcctgcggcgtgtccttttgcgcgggcgcgccctgcagccgcggcgtaggggcggggcttgtccccgcccagggggccgatgcggacagaagataaattgccttgaaggggcaagcggggccaccctggtgggtggctatacgggaagggagaaaatacaggcttgtaggggcgggtgcccacacccgcccgcgggcggccacaagggccgcccctacagagtctgcgcggcggcaagccggccggcccgccggtgcgggacggcaaaatacgggctctgggcatgaaggaaacaggacgccgcagtgctgcggcgtcctgtctgttccatctgcggggttactcacccaccacggcggcgcagcggtcgcacagctggttgtggtggccgtcggcgccgatgtgctcgctgtggttccagcagcgggggcacttgggggactcgtccagggcgacggcgatggtgcaggggatgaggcagtcctcgctcttctccccctccacggccccggtggtgacggtgaccttggagacgatgcacagggaggccagatccaccccggccaggaaggcggcgtcggactcggacacggagagggtcacgtcggtgtcctgggccttcttgaacacgccggcgttacgggcattctccagggccttgttcaccgcgtcgcggaggctgaccagcttcgcccagcgctcccgggcggccgcgtccagggcaaaggcggcgttgtcgccgggcatgtcgttgaacaggacgctttcggcgtttacgccctgggcgtgcttcatggcgtgccagatctcgtcggaggtgaaggccaggatgggggcgatgagccgggtcatgccgtccaggatgtggtacagggcggtctgggcggagcggcgctcggcctcggcgccgcagtagagccggtccttgatgatgtccaggtagaagttggacatgtccaccacgcagaagttgtagacggcgcggtagacggcgtggaactcatagcggtcgtaggcggcgcgggcggtcttggccagctcgttgaaggtgtgcagggcgtagcggtccagctccatcaggttttccgccggcaccagatcccggtcgggctcgaagtcgcacaggttgcccagcatgtagcgggcggtgttgcggattttcagataggcctgggagagctgcttcatgatgtccttggagatgcgcatgtcctgggtgtagtcggcggaggccacccacaggcggagcatgtctgcgccgtagtccttgatgacctcgtcgggggagacggcgttgcccagggacttgtgcatggccttgccctcgccgtccaccgtccagccgtgggtggcgatctgcttgtagggggccacaccgttcacggcgatggaggtgagcatgctcgactggaaccagccgcggtactggtcgccgccctccaggtagaggtcggcggggtacttgaggtaggggcgctcggccgccacggcggcccaggtggagccggagtcgaaccacacgtccatgatgtcggtctctttggtgaagtgggccttgccgcacttggggcagacgaagccctggggcagcagctcggcggcctcccggtcaaaccagacgttggagccgtgctcacggaacagcccggccacgtgggcgatggtctcgggggtgacgatatcggccccgcagtcctcgcagtagaagatggggatgggcacgccccagacgcgctggcggctgatgcaccagtcgttgcgctcggtgatcatggaggtcatgcgctccttgccccactcgggcttccactggatggagtcgcaggcctttaccgccgcgtccttaatggcgtccacggagcagaaccactgctcggtggcccggtagatgatggggtgcttgcaccgccagcagtgggggtaggagtgggtgatgttctccttggccaccaggaagccctcggcctccagatcggccaccaccatgtcgttgcccttggcgtagaactggccgttgtagcgctcgtcggtcatgacgcccttggcgttgacgggcacgggcacgccgatgtgggtcaggccggccttgtcgtactgctggcaaatctggaagtcctccgcgccgaagccgggggcggtgtggacgcagccggagccggcgtccagggtgacgtgctcgctgttgaggatgacgctctcccggtcgaacagggggtgcttggcgcgcatcagctcgaacgcgctgcccttgagggtggccagcacggtgcaggcagcgtagtcaatgcccgcggccttgcacacgctctcggccagatcctgggccagcacgtatacatcgccggagggcacctggaggagcacgtagtcgaactccgcgttgaggcagatggcgtagttgccggggatcgtccagggggtggtggtccagatcacgaagtaggtgcgggacaggtcggcatactggcccagcttgcccttgtcgtcggccacggggaacttgacgaagatggtggtgcagggatcgtcggcgtactcaatctcggcctcggccagggcggtctggtcaaaggggcaccagtacaccggcttcatgcccttgtagatgaggcccttctccgccatcttgccaaagacctcgatctgcttggcctcaaactcgggcagcagggtgatataggggttctcccactcccccagcacgcccaggcgctggaactggccggtcatcttctcgatgtagctctcggcgtactcccggcacttggtgcggaactgggcggtggtcatctcgtcccgctttaccttcttgtccttcagaacggcggactcgatgggcaggccgtgggtgtcccagccgggcacatagggagcgcaccagccggtcatgttgcggtgcttgacaatcatatccttgaggatcttgttcagggcggtgccgatgtggatgttgccgttggcgtagggggggccgtcgtggaggacaaaggtgggcttgccctcgttgcgcttcaccatcttgtggtagaggtcgtggtcatacatctcctggagcatctccggctcccgcttgggcaggcccgcccgcatggggaagtcggtctggggcaggtggacggtctggttgtagtccatgggtcagttctcctttatctttgatataaaaacaggttggtgtaaaggcgtgcgcccttgccgaaattggcaaaaacaaaacgcgcctttgtctcctgtaagagacaaaggcgcaaacctctgcggtaccactctcattgccgcggcgtgccgcggcccctcgaaggccggtaacggggccagccgttcccgcttactgccccaggggggattcggcgggacgctcggaggtgatcttcccagcccttccctgtccgccttgcaccaaaacggcggctctctgcgcaggggcggggacggtactcgtcctcttctcggcgttttgcgaaataaaagatactcggagacacgaaacaacgtgtctccgagtatcttacccgttaaatgcccttctgtcaagggggtttacttgatttcatagtccttgccgaactggaggtggtcaaaatcgatgcggcgggtgggctcggtgggctcgtcagcctcctccggactgtgggagcggctcagctccagcagctcggcatacaggccgccgtccttctccttggcgccgccgccgagatccaccgtgtcctccgcgtcctcctccggcgcctcaccggccaccagcttctccacgctctgggagatgtcctgggcggcagaggcaacctggtccaccacaggctccgccggggcggagagcttggacagtccgttgaggtagtccatctcgtgctgatagagctccttgagcttgcccacataggcggcggtggcgttctgggcggcggtgaggcgcatctgctcgctgcggatgtcctgctgcagctccgcaatacgggccttggcctccgtctccgcgttcttcagcagctcggccttcttggcctccgcctgggccaccagctcgtcggccatcttctgggcggtaagcagggccttgcgcatggcctcctcggtggagcggtactcctccaccttgtccaccagtaccttcatcttggccttgagggtggcgttttccttatagagcgtggtgtagtccgccgtcagtacgtccagaaattcatccaccatcgccatgttatagccgccgaaggacgccttggcaaaggcgtgctcggaaacttcctgtggtgtcagcataacgtcattcccccgatttgttcatgtcttccccacccgatgctccgcatcgggcgggaaccccctctttggcatctgccgggcaatgtggattcgcccggcatccgtgttttggcggtgccaaaacgcttgaaacgccggactcccggcgggacaacccggacattttcctgtcctgaagagcagttcagaaatacagcccgttgttctccagttcgtcaatcagatcgcctaaaatatccacgttgtagggcgtaataatataagtagagatggccacctttttgattttgccctcattggcataggccacaccggagaggaaatccagcaggcggcgggcgatatccttgttggtggactccaggttgagcaccaccgtgcgcttctcccgcaggtggtcggcgatctcgctggcgttctcgaagcgctcgggcttgaccagcaccacctgaagctgggtggtggtgtggatattgaccaccttgttgctccggcgctcgttctccacgggaaagatggggccggtgctgtcctgggccttgggggccttccgctccaggcggtcgccgccggtgcggtccatgcgctcgctgcgggagacgggctcgaagtcgtcaaactcctcctcttcctcttcgtcctcataggggcgggccaggcgcttgagttcatctaaaaatcccatttcggtaacctcccgaatttgttctatcctttgtgcatgggaggacggggcccaaacagggcggtacccacccggaccagggtggccccttcccgcacggcgtcctcaaagtcgccgctcatacccatggaaagacagtcaaagctagtcttattatcatccatctgacttcttatgtcaacataaagctgacgcatttttgtaaaaaacgggcggtttccgtccggcccggcggccacgggagggattgccatgagcccccgcaggcgcacatgggggctgccaaccgcctgggcggccagggcggacagctcctccggggaaatgccgctcttggatgcctccccgccgatgttgacctccagcaggatgtcctgtaccagctccagcttggcggcctgggcctcgatggcctccagcaggtgctcggagcccaccgactcaatgagctccacccggcccactacctgccgcaccttgttggtctgaaggtggccgatgaagtggagggccgcgccggcgtaggcgtcgtcgtccaggtgggcggtcatctcctgtacccggttttcaccgcagatggtgacgccggcggcaatggcctgccggatggtgtcggaggtctgcaccttggtggccgccaccagggtgacctccgacggctcccgacccgcctgccgggcggcggcggcgattttctcatttaccagcgcaatgcgctctgcaagggacatgtgtcattacctccctgtctatgactgcgtgatcacttttccgtcaaagagctccaccgaggagaggattacctcgtcgccggcccgcagggcctttttgccgtccgagccgtctgcggacttcaccagagcgaaatcctccagttgggccaggatggtgacgggcttgaattctgcctgctggcccaccaggacgtacacgccggtgaccagctcctgcttttcctcctccgtctccgggtcggtgacggtccgctcctccacgcgcacggactgcgtgggcacgcggatgccggtctgactgtcaaagaccagctccaccgtctgctttcggagcagggtggtctcagacagatagcggtcagaggacagcaccacggccacccggccgttctccggggtctcccctacccgctccaccttcatgtccacctcgcccgaccagtcccgggagaagcggacggtgacggtgcggccctcgatgagccgcccggcctcctcctcgcccatggcgcagacaaagtaccaggtggcatcggtgaccagcttgcccaccgcgccggcgtccggctggggccgctggcggtcgagctggctgagctggccgggggtgatggtctccagcagagcgggggtgagcaggctctcatagccgtcggtctgcccggaaaagacccccgcctgaccggcggtgaggcggctggtgtcctgggcggcctgggcgctcagcgccgcaatctgggcgtccaccgcgtcaatggaggactggatggcggcggcggcatcgccgtcctcttccccgccgttgaaggtgaagtcccgcttgtagaccaggctcttgagcagcagggtctcgtcctccagccgggtgagatccccggtggacaccgaggagcgcagggccacgatggcgtcgatcacctgctggctgagctgggaggagtcgcccccgctctgggtccgctccagggcgtattggagctgctccttttccatggtcaggctctgtagctcctccttccgcgccaggccggagtcattctggtagagcagggccaccgtctccccgcgggagaccttctccccctcctcgggcagcagatccacaatcccgccgggactggcgagcacgctctcctcccgtaccagaaagccggtggcctccagactgtcgtccacagtgtaggcgtaggacagcaccagggtatagggatcgcggaagctccgccaggcggacacgcccagatacaccaggacggccgccagcagcagcagcatgacaattcggttgatcagggttccttgcttcatggcagctccttagtctgccgccccctccgcctccaaagagatggcccgctccggcacaatggtggagatggcgtgcttgtaaatgacctgctgcttgtcccccgtcataagtaccaccacaaaggcgtcgtagcccgtgatctgtccccggagctgatagccgttcatcagaaatacggtcaggctggcgtgggacttgcgggcgcggagcagaaacaggtcttgcaggttgttggtcttttgcatgtggatgcactccttctatctataagatgcatccaatatataccaattatcgggcggatttcgtcgaaacggcgcggggctgtgtctcttcggcgttttcccccacggcctccgccaaacttggaagcgagtgcgctgtacccgcctgggcaaggccgccacggactgcggtgggccggaattgccctaggtttgactgtggcttccgcgtaggggcggcccttgtggccgcccggccgagcgatagggctgcgggcggtgcgcggtcaaatcaggctcttccgaagcgtttttctagctgctggcgggtcagctcaatggccaccggccgcccgtgggggcaatatttgctccccggcggacctgtccaccgggggccccgagaggattttacatcctcggggcaagtgaattgcccctgcggcaaggttttcgccggaggcgaaaacacttggacgcgccaaaggcgcgaagcgcggtcaaatcaggctctgccgaagcgtttttccagttgctggcgggtcagctcaatggccactggccgcccgtggggacagtatttgaccgcgccggacatgaccgcctgggccaccttgagtagctcggcggggctgttcctctggccgcccttgatggccgccttgcaggccatggtgtggagcagggcgtcccgggccgcgccgggatcggcggaaccgccggtgagcaggcggccggccagctcggagagcacgtcggggatctccccggcggccacgtcgctgggggcggcccggacgatcagcgccccgccgccgaagtcctccgcctcaaagccgaagcgccccagcagcgggagctgggccagcagggcggccccctcctccgccggaggggtgaacaccaccggctccagcagggcctgcaccatgggctggtagccctcggccttcatccggtcgaagttcagccgctcgtgggcggcgtgcttgtcgatgaagagcaccttgtctccctgctccacgatgatgtaggtgttgagcacctcccccgccatgcgccagggctcctcctccgaagggggcgcagagggttcgccggcggggcgggcggctggaaaggctgcccctaccggatgggcgggcggggcttcagccgggcggatgtgggcatccgccccgacgggccggacggtggagatgggtgcgccggaggcaggggcggattcagccgggcgggcacggccgtccgttcgcgcgtgcggcgcggcggaggttgggggggcggagatgccgctcccggcggggacaggtgcggcttcggccgggcggatatgggtgtccgccccggcggactgggggatggagatgggggcgccggagacgccgttcccggcaggggctgccggggcggcccctgtggcccggggggcggtgaagtcgtggaggggcaggggcgttgcgggccgttccgccgtccggcggaactcctccagggtcatctcccggtaggtgggggccgccggagcgggctccgccgggcggaggggagcctccgcaggccgccccccctccgcagggcgcgggggcttcacctggagggacggccgggtgcggtcggcctccagagtggacttaacggcatagtacaccgcgtcaaagaccttcttgtcgctgccgaacttgacctcctgcttggtggggtgcacgttgacgtccaccgcgttgagccgggtggtcaggtggaggacgcagccgggaaatttgcccaccatcttctggttggcgtaggcctcctccagggcggccatcatggtgcggctcttcacataccggccgttgacaaaaaagtgctggtagccccgggtgccccggcagcaggtgggcagggagacaaagccggacaccgacatatcctcccccgagcccttcaccggcgtgaagcccagggccatatcccggcccagcacggcgtagagggccgactgcacctgcccgtcgccgggggtgagcagctcctgcttgccgtcccggaggaacttgacgctcacctccgggtgggacagggccacccgctgcaccatggcgaagcaggccgccccctcggcggtgtcctttttcaggaacttgagccgggcgggggtgttgtagaacaggtcgcgcaccaccattgtggtgccctgggggcagccggcctcctcccggtgcaccaccgcgcccccctccagggagagggcggcccccaaatcctcctccgccgtgcgggtgagcagctcgatgcgggagacggcggagatggccgccagagcctccccccggaagcccagggtgccgatggcctccagatcgtactcggtgcgcagtttgctggtggcgtggcggagaaaggcggtctccgcctcggcggcggcgatgccgcagccgttgtcggtaacccggatgaggctcatgccgccgtgctggatctccacggtcagggcgtccgccccggcgtcgatagcgttctccatgagctccttgaccaccgacgcgggccgctccaccacctcgccggcggcgatcagatcggccacgtggggatctaattgcagaatgtggggcatagaagcacctgctttctaaaaagggaaaatggggcccccgccgaagcccagcgaagcgggttcggtggggagaggaggcacagcggaacgagcgggctttgccgtatacggcaaagcgaggaatgggcaagtttgtgccgacgaagaagcgcctgcgttccaagcggggaaataagcgtaggggcgacccttgtggccgcccgcgggcggcggggagggccctccctacgctcccaggacggcggaggcgagaatcagggcgttgagcaccatgtgcagggcgatggggctccagatggagccgccgttgtcgtagcaccaggtcagggccagggacatgggcacatactggaggaacagcagcaggtagcggaaatccaccgtgccgtaggaatagacgaactgccagacgcagtaaagggcaaaaaccagggtggagagcacatagcccagcacccggctgtaccgccgggtggcgccgaagagcaggccgcggaacagaggctcctccaccaggggcatgagcaccaccaggatcaccaccgtggccgccggggagagggcaaactgctgggcgtagctctccgggttgggattctgtaccggcaggggaatgagcatgaccagcagatggagcacccccgccccgacgagcccggtgccgaaggcgaacaggttttccggcagccagtccagcagcaggtcaaacccgtgccgcaggaacgtccagaagaccagaaagaccagggtagcggccaggaggtagtagaccacgttggcctcggccacgggcagttccccgtggaaagcccgctgcacccaccccatggacaggggaaagaccgtcaggtacagggcaaagaacacccacccccggcccatctcggcgcgggtgagctgcggacgccatggacggcgtttggtgtgcatggtggaggtcctctctttctctcggaaattggggtgcggcccggcggagcgggccgatgtgggcagaaggtgaattgccccagaggggcaagagaaaccgccctggggcgtcggcccctccggggcagtccaatcgggtatcaggacgtgcaggggcggggcttgtccccgcccgcgtttccggtgtcccgccgccgggttcgggcgggcggccacgagggccgcccctacagagtgcgtgggagaccggcggcccctctcgtcaaacgccgacacgcaggggcgggtgcccacacccgcccgccggggcggggactagagcatctgcttgagctcgtagagcaggttcatggcctcgatgggggtgagcacgttcacgtccacatcccgcaggcgggcggccgcctgggccgcgcccatgtccagcagggagacctgctcctccggctgtgcggcggccggggcgggggcggcgggtacgcccgcctccagctcctccaggatcttcctggcccggcggagcaccggctcgggcaccccggccagcttggccacctcgatgccgtagctctggtcggcgccgcctcggacgattttgcgcaggaagaggatgtcgtccctcttcttttttgcggcgatgttgtaattcttcaccccggggatctgcccctccagagcggtcagctcgtggtagtgggtggcgaagagggtcttggcccccaggcgcttcttgtccgcgcagaactccagcactgcccgggcgatggacatgccgtcgtaggtggaggtgccccggccgatctcgtccaggatcagcaggctcttggcggtggcgtttttcagcagctcggccacctcggtcatctccaccatgaaggtggactgcccggcggagaggtcgtcgctggcgccgatgcgggtgaacacccggtccacgatgccgatgcgggcggagcgggcggggacgaaggagcccatctgggccatgagcacaatgagggccacctggcgcatgtaggtggacttgcccgccatgttggggccggtgatgatggccaccgtgtcgtcgcggttgtccatgtgggtgtcgttggggacgaaaagggcgtgtttgagcatcttctccaccaccgggtggcggccctcggtgatctcgatggcgtcggagagatccacctcggggcggcagtagccctgctcggcggccacggcggcgaaggaggagagcacatccacctgggccacggcggcggcggagcgctgaatccgccccacctgggcggccgcctgctcccgcaggtcgcagaacagctcaaactccagggcggtgatgcggtcctgggcggagaggatctcgtgctccagctccttgagctcctgggtgatgaaccgctcgcagttggtgagggtctgcttgcggatgtaggtgtcgggcacctggtcgtaataggacttggacacctcgatgtagtagccgaagaccttgttgtagcccaccttcaggctcttgatgccggtcttctccttctcccgggcctcgatggaggccaccaggccctttccgttggccataatgtcccgcaggcggtccacctccgggtggtagcccgcccggatgaagccgccctcccggacggagaaggggggctcgtccacgatggcccggccgatgagctcccgcagctcggtgagatcgtccagctcctcccgcagggaggccagcagggcggaggagcagccggccagccgctcccgcagggcgggcagcctgcccaggccgtttgccagggccaccagatcccgcccgccggcggtgccgtagacaatgcggccgatcagccgctccagatcggtgatctcccgcagggtgagggtcagctcctcccggccgatggcgtcgcccaccagttcccccaccgcccccaggcggcggccgatggccgccggggagagcaggggccgctccatccacgcccggatcagccggtggcccatggcggtgcgggtcttgtccagcacccacagcaggctccccttcttctccttggagcgcagcgtctcggtcagctccaggttgcgccgggcggtgagatccagctccatgaactgcccggtggtgaagtacgtcagggtggagaggtgggacaggtcggtcttctgggtctcatagaggtaggacagcaggccgcccaccgcctggagggcggcgtcgtccccggcgggcagggcgtccaggccggcggagaactgcttctccgccgccgtgcgggccgcgtccagccggaagcgggcctcgcccccgttctcgcagcggcagtccaggcgcttgaccaggaagtctaccagggccccgtcgctgtacgccccgtcggagagcatggcctcccgaggggtgaagcggcccagctcgttatagaggtgctcgtccgcctccggcccggtgaaggaggtgacggagcactcgccggtggagatgtcgcagaagcacagccccgtgcccgcgctgtcccggtacacggcgcagatgaagttgttgcgcccctcctccagcatggaggaggtcatcaccgtgccgggggtgatgatgcggatgatgtcccggtccaccagccccttggccagggcggggtcctccatctgctcgcagatggccaccttgtagcccttggcgatcagccgggcgatgtaggcgtcggcgctgtggtagggcacgccgcacatgggggtgcgctgcgcctccggcttgccccggtcccggctggtcagggtcagctccagctccttggataccagcttggcgtcctcgttgaacatctcgtaaaaatcacccagccggaaaaacaaaatacagtccgggtgcagctccttcatgcgcaggtactgctgcatcatgggcgtggtctctggcggcatagcgtctctcctgttctatctctctgtgtagtagcaatccagctcccagcgcagggggttgttgtcaatataggtccagatgcgcagaaagtcgttttcactgcggacaatatggtcgtagtagccccgctgccaaaggcggccggcctccagtccccgcccggcggccagatggacggaccgggatttcacgccgcctacaagccgtcccagctctgcggcggcccgcggctcactgtctgtgggggcaacccttgcgtccgcccgcgtcccggctcctgtggggacaatccttgcggctactcgcgtttggccgtctgcgggggcaattcttgtggcggcctgcgtcccggctcctgtggggacaatccttgcggctactcgcgtttggccgtctgcggggacaatccttgcggcggcctgcgtcccggcccctgtaggggcggcccttgtggccgcccgttccagcgtcaggagcagatggacatggttgggcatgataacctggtgctccacccgtactccggtaagcgcgatggactctgccacacattcccccagcggggtgagaacgaggggcgggcgaccacaagggtcgcccctacggatggaggagaggacggggcggtgcgctgaggtgcagaacgtcacaaaataggtgccgcccgcgccgtagtcccccccccgcaggcgggggttcttccgctccggcctatcgggcgtcactgcggcccaccaggtagtcgatcgttacgccaaaataatccgccatgcggatcagcgtgctgacggaggcctcccgttcgccattctcatagcggtgataggttcggaggttaattcccgaggcattcgcggccacggactgagagacatgcttttcttcccgcaggagcaaaagccgttctgcaaaagttgccataaaacctccttgacattgaccgaatgggcaatgtataatagaaatagaattgaccgttcggtcaaagattggggggctatccgatggaacaaattttagacgttctctacaactatatctaggaaaaccggattgcgtattatctgaacggcgacccggaatactgtctggccgggcggcggatggacgaggcggaggagtggctggaggccaacctgccgccggaggccagggcgcggctggagcgtctggcagcggcccgcgccgagcgggacttccggtatgagcgggcgctgttccgctgcgggctgggcctggggctggagctggccgggtcaggccggctccccggatagggaccacttgttggccccggtgatcttcacgtccacaaactggccgatcagaccctcgcccccggtcaggcgcaccagccggttgccgggggtgcgggcggtgaggcccttgtcgtccttcccgtccaccaggcagcggacggtttttccgatgtaggcggcgtgcttttcctcggaaatctggtcctgccgctccaccagccgctggaagtgggccgccttctccgccttggggatgggatcgtccattttggcggcgggggtgccctcccggggggagaagatgaaggtgaacagcgcgtcgaagcgcacctcgtcgatgagggtcatggtgtcctcgaactcctcggcggtctcgccggggaagcccacgatcacgtcggaggtgatcaccacgtcggggatggcctggcgcaggcggcgcaccttgtccaggtagcccgcccggtcgtacacccggttcatggccttcagaatccggtcgttccccgcctggaagggcaggtggaagcagggggcgatcttgggggaggaggccatggtgtcgaagagcttctgggaggcgtccttggggtggctggtcatgaagcggagcaggaagtcgccggggatctccgaggctgccctgagcaggtcggcgaagtccatgggctcgtccagatccttgccgtaggagttgacgttctggcccagaagggtgatgtccttgtacccctcggccaccaggccgcggatctcgtccaggatgatctccggcctccgggagcgctcccgcccccggacgtagggcacgatgcagtaggtgcagaagttgttgcagccgtacatgatgctcacccacgccttcaccccctcctggcgcaccagggggatgccctcggcgatggagccgggctcgtcggcgatgtcgaagatgcgcccccggcgggtcacaaggcggtagagcagctccgggaaccgccacagggcgtgggggccgaagaccagatccacctgccggtaggagtccttgatcttctgcgccatgtggggctcctgggccatgcagccgcacacgcagatgagctggccgggcttggcccgcttggtgtgcaccagcgcgcccacgttgcccagcacccgcatctcggcgtgctcccggatggcgcaggtgttgatgacaatcaggtcggcctccgcctcgctctgggtgaactggtaccccatctcgctgaggtagccccgcagccgctccgagtcggcctcgttctgctggcagccgtaggtgtccacaaaggccaggggcgcggacggccgggcggcgaaccgctcgtggagcttctggcagaaatcccgctggcggtccacgtccgcgggggaaattcgggtggtctgtcgattcaagctggttcctccaaaaagagtatttcaatctcaaaatcatatcacttttcctgtcgaaacacaagcggaaaccccttttcgttgacggaaactttctgggagtatataatagaaaaaaccaggcaagagagagaggcggggccatgaaaacgctggtcatcgagcgggaggctgtaaagaacaacatcggcgtcatcaaggagcgggcgggcgaggccgtgatctacgcggtgctcaccggcgacggccagggggccgggctggtggagctggcccggctgctgcgggaggagggcatcggccgcttcgccgtcagcgagcccgccgaggccgccgccctgcgcagggcgggctttgtggaggaggagattctgatgctccgccccaccgtggaccgggcggagctggagcagctcatcgatctgaacgtggtgtgcactgtgggctcggcggacacgggcatggccctcaacggcgcggcggaggcccgctccaccgtggtggaggcccacatccagatcgacaccggcatgggcttcggcggcttcctggccgacgagccggagaagatcctctcggtctaccgcaacctgcccaatgtggccgtgtcgggcatctgcacccagctccacgcccggaaaaagggcggagaggatctggccgcccggctggggcagttccaccgggtggtggaggccatccgggccgcgggctttgagacgggggttgtccacgccgccgggtcctacgccctgctccactgcgccgacgcccggctggacggggtgcgggcgggctccgccctgctgggccgctgccgccgcgtccacggcgacgggctgtaccgggtgggttacggcgaggtgggcattgaggaggcccgctggctccccaagggacacacggtgggcagcgcccgccccgtcgtcctccggcggcccacccgcgtggcggtgctgcccgtgggctatcagaacggcttcggcgtggcccgcgcccagggcagcggcctgggcgccctgctgcggcgctggctggccgcccggcggcgcaccgtccgcgtcaacggccagcgggcccgcatcctgggggccatcggtgccattgagaccgtggtggacgtcaccgacctcaagtgctccgccggcgatccggcggtgttcgacatcgaccccctgtacgcacgggggtttgtgcgggagtaccggtagcccggccgccctggggtgccggcccctgcaacaaacaaagagaagggaatttgagcgatgcgcgcagttgttaccagagtgaagagtgcctccgtcaccattgacggccgggtgaacggcgagatcggccaggggctgctggtgctgctgggggtgggccccagcgacaccgaggcccaggcggtgaagctggccgacaaggtgtgcggcctgcggatttttgaggacgagaacgagaagatgaacctgaacctggaggcggtggggggcgcgctgctggtggtgagccagttcaccctctatgccgataccaagtcccgccgccccggcttcaccggggccgccaagccgccggtggccatccccctctatgagaaatttatggccgagtgcgccgggcggggtttccgggtggagcacggcgagttcggcgcagacatgcaggtgtactcgcagaacgacggaccggtgaccattctgctggacaccgaccagatgtagggccgaactcgcccccgcgcccccggcgcgtccgagcgttttggcggagccaaaacctcgatgccggggcggattcactccgccccggcagataaagggaaccggggtccccgcggggtgggagccccgtggggcgttcggggcggatatgcaggtgtattcgcagaacgacgggccggtgacgattctgctggacaccgaccagatgtagggccgaactcgcccccgcgcccccggcgcgtccgagcgttttggctccgccaaaacctcgatgccggggcggattcactccgccccggcagataaaaagggaaccggggtccccgcggggcgggagccccgtggggcgttcggcgcggatatgcaggtgtactcgcagaacgacgggccggtgaccattctgctggacaccgaccagatgtagggccgaactcgcccccgcgcccctggcgcgtccgagcgttttggctccgccaaaacctcgatgccggggcggattcactccgccccggcagataaaagggaaccggggtccccgcggggcgggagccccgtggggtgttcggcgcggatatgcaggtgtattcacagaacgacgggccggtgaccattctgctggacaccgaccagatgtagggccgaacgcgccccggcgtttgcgggcggccacaagggccgcccctacgaattccgccgaatacgatgtcatatcaggaggcattccgcccggtaggggcggcccttgtggccgcccacggaggcgcaggcacagacaaccattgatgaggtgaaaaaggatgcagatcaaagtgatgcaggtgggccagctgggcaccaactgctatttgctggaggacgaggagacccgcaccgccgccgtggtggatcccggcggggagggggcgcgtatcctggcccaactgaaggcggacgggatggagctcaagctcatcctgctgacccacgcccacttcgaccacaccggcggcgtggccgagctgtgcgccgccctgcctggggtgccggtgtatctccacccggccgacgcggccctggtggggggcgacgtgttccccgccgtcggcgcggagacgacgccctatcaggacggggacgtggtgaagctggggaagatggatattgaggtgctccacacccccggccacacccccggcggggtgacgctgaaggtgggggacgtgcttctcaccggcgacaccctgttccagggctccatgggccgcaccgacttcgagggcggctcctacgcggagatcatggcctccctggggcggctgggccgcctctccggcgactaccacgtgcttcccggccacatgggggcctccaccctggagcaggagcgcaagaccaactactacctgcgggaggccatggagggataaggcggaaggccgccgccccccggagaaaggacacggcccatgaagctgtatttacacggacacgactacaaatacgccgccgagcagatgctgctggttccccacgggagcggtgctcctgcgggggccccgtctgatttttatgtatcgccgggcggaagtgaatcccgcccggctccgcgccattgggcgcgggagcgtcagcagcatggggaagggaggcggccatgaagctgtacttatacggacacgactacaaatatgccgccgagcaaatgctgctgacgctgttccccgcccagcggccggagtatcccgccgggcccccggcgccgggggaggacgcgctggtgctctccctgcaccggggggcggtctgggccaccgccacggcggcgctgagctatgggggacgggaataccgggccgcccgccgatgccggacggcggagctgaccgacccgctgtccaccgaccgggcgctccagcggattttgaagctggccttctacgacgcgggcaccgccgcccggggcggcgagcccccctggggggcgctgaccggggtgcggccggtgaagatccccaccaaggccatgctggccggggccggcccggcccaggcggagcggctgctgcgggacacctatcgggtgacggagggacggcggcggctggccatggactgcgccggggccagcctggcggccctgcgcagcctggcccccggtgaggtctccctctacgtgggcatccccttctgccccacccggtgcgcctactgctccttcgtctctgccgacgtggggcgggccctcaagctcattgaccccttcctggacgccctgtgccgggagctggccgccacgggggccatgctggcggacgcggggctgcgggtgcgcaccgtctacttcggcggcggcacccccaccaccctctccgccccccagctcgaccggctcatgggggagctggcggaccacatcgacctgtcgggctgcaccgagtacacggtggaggccgggcggccggacaccatcacggcggagaagctggcggtactggcccgccgggggtgctcgcgggtgtcggtgaatccccagaccatgcaggacgcggtgctggagcggatgggccgggcccaccgggcggacgacattctccgggcctacgccctggcccgggagagcggcatcggctgcatcaacatggatctcatcgccgggctgcccggcgacagcgcggagggcttccgcgcctccctggagcaggtgctggacctggggccggagaacgtgacggtgcacactttggccctgaaaaagggctcccggctgatggaggaggggggcggcctgccctccggcgcggcggtggcggatatgctggatttcgcctgggccgccctgcggggggccgggcagaggccctattacctctaccgccagaagtacatgtccggctcctttgagaacgtgggctggtgccggcccggcgccgagagcctctacaacatctgcatgatggaggagctgcacaccatcgtctccctggggggcggcggagtgaccaagctggtcgaccgcgccaccgggtacatcgagcgcctggccaacgccaaatacccccaggagtacatccagaagatcgacgctatctgcgcggacaagggcagggtggcccaattttacgccgcgcacggaaggtaaaggagggaagacatgccctatcagctcagtgagatcaacgaaaaaatccggcgggacccggccgcctttctggccgagtgtgacgcccactaccaggagcgcatccacgccgccgtggacaagatcctggcgcggatgaaggagagccccatcgtgcttctgtccggcccctccggctcgggcaagaccaccacggccatgaaggtggagcgggagctggagcgccggggggtcaacgcccacacggtgtccatggacaactacttcaagaccctcaaccgcaggaccgccccccgcacgccggagggggacatcgactacgagtccccgaaactgctggacatggagctgctggacgagacctttgaccggctgtcccggggggaggaggtcatcgtcccccacttcgagttcgcccgccagatgcgcaacgacagccggggcacccccctgcggctggggaaggacgagattgccatcttcgagggcattcacgccctcaacgacgacattgccggccgccacccggaggccacgggcatgtatatctccgcccgctccaacatcctggagggggagcagctgcgcttcaagggcacctggatgcgcatctcccgccgcgccgtgcgggactacaatttccgcgggacagacctgttggaaacgctgctgatgtggtataatgtccgccggggggagaaaaagtatatctcgccctacaagggccgcgcccatgtgatcatcgactcctccctgcgctatgaggtgccggtctttgcccattacgccgacgccctgcgggcggcggtggagcaggtgccccccgacaacgagcgctggcaggagtaccacgatctggtggacgccttccggtattttgagccggtggatcccgccctggtggcccccgactccctgctgcgggagttcatcggcggggggcgctaccactactgaccggcggggcggcacacaggccgccctctgtgccgtatcagaaggccacccgtaggggcgcacctgcgtgtgcgcccgtcaggcggccgcgggccctgcggattgtatgggcggcgcggcggggcagggccgcgatatatcgcggccgtgtcccagtccgccgtccgtatgtcccgcccaaaaccctgttaatcacataggaaagaaggaacgaaaatcatgtccgattgtacgcacgactgctcctcctgcggcgagagctgcggggagcgcaccgcgccccaggacttccgcgccccggccaacggcctgtcccacatcgggaaggtcatcgccgtggtcagcggcaagggcggcgtgggcaagagcctggtcacctcctctctggcggtggccatgcgccgcatgggcaagacggtgggcgtcctggacgccgacatcaccggcccctccatccccgccgccttcggcgtccacaccaaggccgagggcagcgagctgggtatctacccggcggagaccaaaaccggcattgagatcatgagcctcaacctgctcaccgagaacgagaccgacccggtggtatggcgcggcccggtgatcgccggggcggtgaagcagttctggaccgacgtcatctggggcgacgtggactacctgtttgtggatatgccccccggaaccggcgacgtgcccctgacggtgttccagtccctgccggtggacggcatcgtggtggtcaccaccccccaggacctggtgagcatgatcgtcaccaaggccgtcaagatggccgagatgatgcacatccccgttctgggcctggtggagaactacagctacttccgctgccccgactgcggcaaggagcacgccatcttcggcgagagccacatcgagcgggtggccgccgatctgggcctgaaggtgctggcccgcctgcccattgatccggccgtggccgccgcctgcgacgcgggccggattgaggagctagagcccaactatctgaccgccgtggccgaactgctggcggagtaagcgggtcattcctttacaaaatattcatatccggttcaaaaggggttcacagggatggaataggataacagcgtggtcagagatgaccacgccccctctctttcctctcttctttcaattacgaaggcacaggcccgcgaaaggcggcgggcctgtgttttcgcgtatatggagcgtgagacgatgaaaatccggttggagccggtgaccgtggcttccagggccgctgtggagcggctggagacggcccccggacaggagggctttgtggagagcgtggcggagtgcctggccgaggcggaccggcggcggtgctggcggcccgtgggggtctatgatggggatgccctcataggcttcgccatgtacggctttttctgggagtacctgccctttggacggctgtggctggaccggctgctgatcgaccgccgctttcagggccgggggtacggccgggccgcgctggccgccctgctggagcggctggagcgggagtaccacaaaaagcggatctacctcagcgtggtggaggccaaccggccggctgcggcgctgtacgagtccttcggcttccgctttaccggcgagcgggacacccacggcgaacgggtgatgtgcctgcgcacccgctgaaccgggcaaaagcgcccgcccccttttgggggcgggcgcttgcgttagggaaacacggcctggacaagcaccatatacaaaatggtgcctccgaagatgctcagcagggtattgctgcgccacaggtgaaggatcaccaccgccgccacggacacgagctggggcacccagccgccgggggcggcaaaggacacgccccggagacagtatacgatgagcatggcgatgatggccggtggcaaaacccggcccaggtagaggaccagcttggggggcgactccccccggtcaaagagaaggaagggcagggcgcgggtcagaaaggtgataatggccatgaccgcgatggcggcgacggcccctgcggtgctcagcatgtctcttcctccttctcgtccagcctgtcccgcaggaccagcaggcacagcacaatcacgcccagcgagatgagcagcatctgatcctggccgaagaagtggcccaggacaatcagaaacagcaccgtcaccccggcccccagaacggcgggcaggtgcctccggtagctcctccactggtccacggcgataaccacgaacagggcggtcatggcgaagtccaccccctcggtgctgaaggggatcagcgccccggccactgcgccgatgaccgagcccagaatccagtagctctggtccagcagggcgatggcaaaatagaaattccgggggtccacccccaccggggcccgggctgaggacagcagggcataggtttcgtcggtgagggagaagatcatatagagcttgcggggacccatgccacggaacttctccagcatggacagaccgtataccaggtgccggaagttgatgagcagcgtcatgaccgccaccgtgcccagggaggcggcggcgcccagcagggtcacccccaggtactgcccggaaccggcgtagatggtcaggctcatgaagaaagcccagatgaagttgtatccaatctcctggagcatcagcccgaaggcgatgccgatggccaggtagcccatcagcaccggcaccgtcaccgggaatgccgcggagagcgctttgcggtccatacgatacaccccttttgccaaacagtggagtctctattttacacactttagcatggaaaagcaagggggatggcggatttttggcgcttccgtccacagcggaggttgttttttgcccacaatccggtataatggatgcacaaacagatggaggacacccatgaaaaagctgctctttctctacaatacccacgcgggcaagggcctgctgaaaagcaggctggccgcggtgcaggacgcgctggcggcggccgggtgggacgtgaccatccaccccactcagggggctggggacgccacggcggtggccgccgcccgggccggggagtttgaccgcatcgtctgctccggcggcgacggcaccctccacgaggtggtggccgggctgatgggcctggagaaccggccggaggtgggctacatccccgccggtacaaccaacgactttgccaaaaacctctccctcccacgggggatggaggccatggccagggtggccgccgccggtgtgcccaggccggtggacatcggctccttcaacgaccgctatttcatctatgtggccgccttcggggcctttaccgacgtggcttacagcacgccccagccggtgaaaaatatcttcggccacctggcctacgtgctggagggggccacccgcctggggtccatccaggcctaccccctcaccgtggagcacgacggcggcgtggaggagggcggcttctgctacggcatggtgagcaacaccgtgtccgtggggggcttcaagggcatgcccgccgagcccgtccgcctagacgacgggctctttgaggtggtgctggtgcgccagccccagaatcccctccagctccaggcggtgatcaaggcgctgctcaccatgtcccccgacgagggcgggctggtgaccagcttccgcaccagccgcctccgggtcgcctgcggccaggagctgccctggactttggacggcgagttcggcggcgcacccgccgtcgccgagatcgtcaaccgccagaaagcggtgaccatcgtctacggcaagtaggggcggcccttgcggccgcccggctgggccggggactctggcggagtgcgggggctgcgggcgggtgcaggcacccgcccctatgggtctgcgttgatgaaagagttagtgcaaaaatgtaggggcggcccttgtggccgcccggccgggctggggactctggcggagtgcggctgccgcgggcggggacaagccccgcccctgcgggtctgcggcaagggaagtatttcccgcaaaatgtaggggccgatgcctacatcggcccgctgagccaaatttggcggtttttccactgcccggcccgttggatactttgaagcgagaaggaacatacatggattacgaagcaggaagttacgatattgccgtcatcggcgcgggccacgcgggcatcgaggccgccctggccgcggcgcggctggggctgaacaccctgtgcttcaccgtcaatctggacgcggtgggcaacatgccgtgtaacccggccatcggcggcacgggcaagggccacctggtgcgggagctggacgccctggggggagagatggcaagggccgccgaccaggcctgcatccagtaccggctgctcaaccggggcaagggcccggcggtgtggtccctccgggcgcaggccgaccggaggagataccaggagatcatgaagcacaccctggaacagcaggagcgcctgtgggtgaagcaggcggagatcaccgatatctacgccgaaggcggccgggtcaccgccgtgcgcaccgcctacggggcggtgtaccgggtgcgggcggtggtggtggcctcgggtacctacctggggggccgcaccatcgtgggggatgtgacccgctcctccggccccgacggcctggccgccgccctccccctgaccgagagcctgaaaaggctgggcctgggcctgcggcggttcaagacgggtacgcccccccgggtgaacgcccgcagcgtggatttctcccagatggaggtacagccgggggacgagcgggtgctccccttctcctttgagacggcggagccgccggagaaccgggcggtgtgctggctgacctacaccaatgccgccacccacgccgttatccgggccaacctggaccgctcccccctgttctccggggtgatcgagggcatcgggccccggtactgcccctccatcgaggacaaggtggtgcgctttgccgacaaggagcggcaccagctctttgtggagcccatggggctgaacaccgaagagctctacatccagggcctgtcctcttccctgccggaggacgtgcaggtgcagatgctccacaccattcccggcctggagcgggcggagatgacccgcccggcctacgccatcgaatacgactgcgtggatcccaccgagctgctccccaccctggagcacaagcgggtggcgggcctctatggggccgggcagttcaacggctcctccggctacgaggaggccgccgtccagggcttcgtggccggggtgaatgccgccctgaagcttctgaaccgggagcccctcattctgcggcgggaccaggggtacatcggggtgctcatcgacgatctggtgaccaagggcaccaatgagccttaccgcatgatgacctcccgcaccgagtaccgcctgctccaccggcaggacaacgccgaccggcggctgtgccccgtggggcacgccattggcctgatcagcggcgagcggtatcagcgggtggtggacaagtacgccgccgtggaccgggagatcaagcgcctggagcacaccggcaccgcggagggccgcctgtgcgacctgctccgccggccggagaacacctatgagagtctggccggggcggatccggaccggcggccgctgcccaccgccgtcacggaggcggtggagatcgccgtgaaataccagggctacatcgaccgccagctccgccaggtggccgagcagcggaagatggagagccggcccctcccccctgatctggactacctgtccatgcagggcctgcgcaccgaggcccggcagaagctggacaaaatccggcccctcaacctggggcaggcctcccgcatctcgggggtctccccggcggacatcgccgcgctcatgatccatctggagcggccccagggcggagagggggcgggcccctgccccgcaaaatcccaggaaaaggagacgctatgaaggaaaagattgtgctgggcctgtccggcggggtggactccgccgtggcggcccggctcttacaggagcggtatgaggtcaccggcctctatctggacatcggcctaggcggcacgggggcggcggacgtcgccgccgtggcggagcggctgggcattcccttcgagacggccgacatccgggccgagctggagcgggaggtgtgcgccccctttgccgccgactaccgggcgggccgcacccccctgccctgcgcccgctgcaatccggcggtgaagttccccgcgctctttgccctggccggccgcatcggggcccggtatgtatccaccgggcactacgcccgtgtggaaaacggggtgctgaaaaagggcatgcccgccaacgaccagtcctatatgctggcccggctgacgcgggaacaattacagaaggtaatatttccgctgggagattacgaaaaaaaccaggtgcgcgccctggcccggggcttcggcatcccggtggcggacaaaccggactccatggagatctgctttatccccgacggggactacgccgcctggctggagaggcgcgggttttccacaccggaggggaactttgtggataaagagggaaaggtgctgggccgccaccggggcatccactgctacactctgggccagggccggggcctgggggtatcggggccccaccggtactatgtgaccgccctgcggccggacaccaacgaggtggtgctctccgacggctccgacctgggccgggatgaggtgcgggggacggagcccaactggctggccgtggatagcctaaccggccctatggaggtcacggtgcggctgcgccactccaagacccagctggcggccaccctggagccggagggggacggcgtgcttctgcggatgcacacccccgcccgcgcccccacccccggccagctggcggtgttctacgacggcgacgccgtggtgggctcggcctggattgtatgagagagaaagagaggacgatggacatgaaaaagctacttggtttggccctggcgtgcgccctgctcctgacgggctgcggcgcccggggcggagacaagggggaggagctgggggacaacaccatccgccccctggagctcaccgaggaggaggcggccctgctgaagctggtggggggctccgacgcggagtatggcctgtttgagtgcgcggccggcgagggtgtgagcgactgcaccgtggaggtactgtcctgggaggacggggcctggcagaccgtggcggaggggggcgtgtccatcagcgccgccgggacgcggcggctgggggtcgtcctcagcggggataagatcaccgtaaatgtccaggacggtggcacccaatacagctacgccccccggctggacgggatggaccgcggcctggagacaggccgggcctcggtctggctggaggaagatcgggccatgaccataggggagcgcacgccgctctatctggagatctatgatgacggggagggcgtgggaattcctcccctgcccggcgggttctccgacttggccaatctcaaccagtacgatcgggcatacgccgtggctgtcaccctgaagggctagaggcgggccgtttcagcaccggcgtaggagcggcccttgtggccgcccggcccctatggatggcaattgtccgcccctatacaaaaacagcgggtattctgtctctggcagaatacccgctgtttttattttacctccaggccggagagataccgccgggccaggtcaaagccgtgggaggcggacacgtggcgtacccgctcccggcccagaccctgctggattttccgcacccaggtgccgtccggcgcggccagggccaggtagaccagtcccaccgggttgccccgctcgtcgggatcgggcccggccacgccggtggaggccaccgccagatcgcaccccagtacccgccgggctccctcggccatggcgcgggccaccggctcgctcaccgccccgaactcgtccagcagcgcctgatccacccccaggacggtgtgcttcacctcggtggcgtagcttaccacgccgccgcggaacacggcggataccccggacaaatcggtcatgcgcttggcgatcagcccgccggtgcagctctcggcgcagcccagggtgaggcccttttccttcagaagctggaacaccgccgcctccagggagggtacgtcggcgccgtagatgagggggccgaaccgggcccgcaggcgctcctccaccggggcgatcagggcccgggcagcctcctcgtccgccgctttggcggtgatgcgcagctcacactccccctccttggcatagggggccagggtggggttggtcatggcctccatctcctcccggagctgggcctccatggaggactccccgatgccgaagagcttgagcgtccgggagacaatgaccccgtcggccaggctcttcaggtaggggatcacccggtgggtgaacatggccctgcactcccggggcgggccggggagcatgatgacccgcaccccgtccgcctcgaaggccacgccgggggcggtgccccagtcgttgtccagaaccgtgcacccctcgggcagcatggcctgctggtagttgttctccgtcatggggcggccggcgtggagccgctcaaagtaggcctcgatgcggcgggcggagggcgcgtggaacaccagctttttgccgaagcactcggccagcacgtttttggtcagatcgtcgcaggtggggcccaggccgccggtggtaataagaatgtccgcccggcttttggccagctccaccgcggcccgcagccgctgggggttgtcgcccaccaccgtgtggtagtagacgttgatgcccagggccgacaggccctgggaaagcatctgggcgtcggtgttggcgatgttgcccagcagcagctccgtaccgactgcgatcagctccgcagtgtgagacataaaaaagacctcctgtcgccaacaccggcatcggcggcgggtgccgccgcaaatgcgcagcgcagcatttccacagggcggattcactccgcccgaggatgtagtaattgggagttctcctccgcggggggagaaaccgtaggggcggcctttatggccgcccgccgtttcccgccgctgcggtcagacctgaacccgctcgatgccgtccacggcggcctttaccaggccctccacgtccagcgcggcctcggcggcctccagctcccccagcacagggcgcagccgggggtggcggggggtaaagacggtgcagcagtcctcatagggcaggatggaggtctcgaaggtgttgatcctccgggcgatgcggacaatctcctccttgtccatgcccaccaccggccgcaggatgggcagggtggtgacggcggtggtggcccgcatggcctccatggtctggctggccacctggcccaggcactcgccggtgacgatggccccggcgccgcaccgctgggccaccgcctcggcgatgcgcatcatgaaccgccgcatgagcacggtgaacagctcctccgggcacttgcggcgcagctcctcctggatggcggtgaagggcaccacgtggacggtgagccgtccgcaccagggggtgagcagcttggccagggtgagcaccttctgcttggcctcctcggaggtgtaggggtaggagaagaagtgcaccatttccagggcaatgccccgcttggcgatcatccaggaggccaccggcgagtcgatgccgccggagagcaggctcaccgcccggcctcccacgcccacgggcaggccgccggctcccggctccggatcggcgtggacgtaggcggcgtagtcccgcacctccaggtagacggtcagctccgggtggtgcacgtccacggtcaggttggggtacttctcgtccagctcgccgcccacgtactgggagagctggatggaggtcatggggaagttcttgtccgcccgcttggactccaccttgaaggtcttggcggccgccagccggtcccccaggtactccacggcggtctggagcatggcgtccttgtccttcgcgcaggcccgggcccggctgagccccaccacgccgaagagcttggtcatggcctcccacgcgccgtccagatcgcagtcctcgctctgcggctccacatacatggtagactgcttggtgtataccttgaatttgccgtgggcctggaggcggcggcgggcgttggccacgagacggtcctcaaaggtacgccggttgagccccttaagcaccagctcccctagttttaacagaataatctcgttcatgtagtctggattcctttcccaaagtttcactattatatccaatttgctttttgttgtccagaggggcgggcctgtctccacccgcgtccgggggcctaccgccgcaggtactccggcgggcggtactggagggcttcggccaggtgctccacggcgacggcccccgccccgtccagatcggcgatggtgcgggccacacggaggatgcggtcgtagctgcgggcggtgaggcccatccggtcgaaggcccccttcatcacggcgcggcaggcgtcgtccagggcgcagaagcgggagagctccgccgggcccatctggtcgttgcaggccgggccgccggggccgaagcgggcggcctgcaccgcccgggccccgtccacccgggccttgatggcggcggagggctccgccggggtccggcgggagagcgcgtcaaagtccagtggcggcacctccacgaacaggtcgatgcggtccagcaggggcccggacaggcggctgaggtacttctccaccgcctggggcgagcagcggcagcggtccgaatagccgtaccagccgcacttgcagggattcatggcgcacaccagcatgaagcgggcggggaacaccgccgtgcccgacacccggctgatctgcacccgcccgtcctccagaggctggcgcagggtctccagggcctccttggagaactcgggcagctcgtccagaaagagcaccccgttgtgggccagggagatctctcccggccggggactggagccgcctccggccatgcccatggcggacaccgtgtggtggggggagcggaagggccgccgcaccagcagggggtgctcagaggtggtgaggcccaggacggagtggatctccgtggcctccagggcctcccgccgggtcagatcagggaggatggagggcaggcggcgggccagcatggacttgcccgatccgggcgggcccaccatgcagaggttgtggccgccggcggcggcgatctccagggcgcgcttcacgttttcctgccccttcacgtcggcaaagtcggggcaggcaaagtcctccggccccggcgtccaggccgccgccggctccagaggggcctcccccctcagatgggccgccaactgccccacgctctccaccgggtagacctccagcccgccggccagagtggcctcggcggcggagggggcggggacgtacagccgcttgatgcccgccctccgggcggccagggccatgggcagcatgcccaccaccggccgcagggagccggacaaagacagctcccccacgtaggcgctgtccggcccgtccagcctgagctgtcccccggcggccagaatacccgccagaatgggcaaatcgtacaccgtgccccccttgcgctggttggcgggagccaggttgaccgtgatgcgggacaccgggaaggtgaagccgcagtttttaatggcggcgcgcacccggtcccgggcctccttcaccgccgcgtcaggcaggcccacgatctcaaaggcgggcagaccggccgacaggtcgcactctgcccgcacctcatagccggagatcccgctcagccccagggagcgcacttcacagagcatgggtgccgcctcctttccctttcgtcatgttgcatccattatagcataccggacccgccgccgaaagggtgaaaagcggccctgtaccggcggagggaaaggggagaacaggatacggcaaaggactgcttttaaaactgcatattttagcatgctcagtttagttagtaatatataactaaataatttttttcaaaggagaacggaaaaaatccaattatttcttctaattcaggaacaaaaagaaaaataataattcagagtaagatttgatttacaaacgtcaatgaaggtgataaaatgtatgcgccccggggggacaggctccgcccggaggcagctgtaatcagccagggtaatgggaatcgggcccggtcagtccgggggatggacggggacggattcccattgccctggaaccatgaacaaggaggaatcgtttctatggcgagaaagctgaaaaccatggacggcaacacggcggcagcgcacgtgtcctacgccttcaccgaggtggcaggcatctaccccatcaccccgtccagccccatggccgacaatgtggaccagtgggccgcccagggccgcaagaacatcttcggcaccaccgtcaatgtcatcgagatgcagtccgaggccggcgccgccggtacggtccacggctctctggccgcgggcgcgctgaccaccacctacaccgcctcccagggcctgctgctgatgattcccaacatgtacaagctggccggtgagctgatgcccaccgtgtttcacgtgtccgcccgtaccgtggccacccacgcgctgaacatcttcggcgaccattccgatgtcatggcctgccgccagaccggctttgccatgctgtgcgagtccaacccccaggaggtcatggacctgggcgccgtggcccacctggcagccatcaagggccgcgtcccctttatcaacttctttgacggcttccgcacctcccacgagatccagaagatcgccatctgggacaacgaggatctggccgacatggtggacatggacgccgtggaggccttccgcaagcgcgccctcaaccccgagcgccccgtgatgcgcggctcccacgagaacggcgacatcttcttccagcaccgcgaggccgccaacaagtactatgacgccctccccgagatcgtggaggagtacatgggcaaggtcaacgccaagctgggcaccaactaccagctcttcaactattatggcgcacccgacgccgaccgggtcatcatcgccatgggctccatctgcgacgtggccgaggaggtcatcgactacctgaacgcccacggcgagaaggtgggcctggtgaaggtccgtctgtaccggcccttccgcgccgacaagctgctggcggccatccccgccaccgccaccaagatcgccgtgctcgaccgcaccaaggagcccggcgccctgggtgaccccctgtacctggacgtggtcaccgccttcgccaacgccggccggcaggccaccatcatcggcggccgctacggcctgggctccaaggacaccccgcccagcaacgtgttcgccgtgtatgaggagctgaccaagtccgcgcccaagcgccagttcaccgtgggcatcgtggacgacgtgacccacacctccctggaggagaagccctcccccaacaccgcggcccccggcaccatcgagtgcaagttctggggcctgggcggcgacggcaccgtgggcgccaacaagaactccatcaagatcatcggcgaccacaccgacaagtacgtgcaggcctacttccagtacgactccaagaagaccggcggcgtaaccatcagccacctgcgcttcggcgacgagcccatccgcgccccctactacatcaacaaggctgactttgtcgcctgccatgtgcccgcctacatcgtcaagggcttccccatggtccgcgacgtgaaggacggcggcgtgttcctcatcaactgccagtggtctgacgaggagctggatcaccacatgcccgccgtggccaagcgctacatcgccgagcacaacatccaggtctacaccattaacgccatcgacctggccatcgagatcggcatgggcaagcgcaccaacaccatcctccagtccgccttcttcaagctggccaaggtcatgcccgaggcggaggccatcggctacatgaaggacgccgccacccactcctacctgaagaagggccaggacgtggtggatatgaaccacaaggccatcgacatgggcgccaccgcgttccacaagtttgaggtgcccgcctcctggaaggacgccaaggacgagaccgtggccgagcacgtggagggcaacgccgccaccgtgaagatggtcaaggagatcatggagcccgtgggccgcatggacggcgacagcctgcccgtctccgcctttgccaacggccacgaggacggcaccttctgccagggcgcttccgcctatgagaagcgcggcgtggccgtcagcgtgcccgagtgggatcagaccaagtgcatccagtgcaaccagtgctcctatgtctgcccccacgccaccatccggccctatgccctcactgaggaggaggccaagaacgcccccgctcaggccaagatcgtggacatcaaggccggcaagggcaagggtgtatacaagtttgccattgccatttccccgctggactgcatgggctgctccgtgtgtgtgagcacctgccccgtcaaggccctgaccatgaagccccaggagtcccaggctgccgagcaggaggtctttgactacatggtggccaaggtggcccccaaggccgacgtggaggacaccaataccgtcaagggcagccagttcaagcagcccctgctggagttctccggctcctgcgccggctgcgccgagaccgcctatgcccgcctggtcacccaggtctgcggcgaccgtatgtatatttccaacgccaccggctgttcctccatctggggcggcccggctgccacctctccctacaccgtcaacaaggagggcaagggtcccgcctgggccaactccctgttcgaggataacgccgagcacggccttggcctgcacctgggccagaaggccatccgcagccgcctggccgacaagacccgcgccctgctggccgtggagtggtgcactccagccattaaggagactgcccagaagtggctggataccatggaggacggcgcggccaacgccgaggccaccaaggcctacatcgccgctctggaggacggcctgtgcacggtggacgagctgctggccagctccaagcccgagatccaggcgtttggcaaagagctgcaggccaagggtgagaagctctgccagtgtgacgcctgcaagctggccgctgagattctccaggagaaggagtatctggttaagaagtccgtgtggatcttcggcggcgacggctgggcttacgacatcggctacggcggcctggatcacgtcatcgcctccggcgaggacgtcaacatcttcgtcttcgataccgaggtctattccaacaccggcggacaggcctccaagtcctccaatatcggccaggtggcccagtttgccgccgccggcaagaaccagcccaagaagagccttgcggagatcgccatgcagtacggctacgtctacgtggcccaggtggccatgggcgccaaccccaaccagactctgaaggccatcaccgaggctgaggcctaccacggcccctccctggtcatcggctacgccccctgtgagatgcactccatcaagggcggtatggccaactgccaggttgagatgaagaaggccgtggagtgcggctactggaacctgttccggttcaaccccgctctgaaggccgagggcaagaacccgttcaccctggactccaaggcccccgccggcggctatcaggagttcctgatgaacgaggcccgctactcctccctgacccgcgccttccccgagcgcgccaaggagctgtttgcccagaacgaagaggccgccaaggagcgctatgagcatctcaccagactggtggagctctacaagtaaacaagctcgcacaagggccccggacgaaaacgtccggggcccgttttatatggcggcctcttcgggggccccgccgacggcggggcggcgctttgcgccgtccaagcgttttgggccgtgggcccaaaaccttgatgccggcggaattcagttccgccggacagataaaataaagatggggtccccggcgggccccggcccggcggggcagagccgccaaggagcgctatgagcatctcaccagactggtggagctctacaagtaaacaagctcgcacaagggccccggacgaaacgtccggggcccgttttatacggcggcctcttcgggggccccgccgacggcggggcggcgctttgcgccgtccaagcgttttgggccgtgggcccaaaaccttgatgccggcggaattcagttccgccggacagataaaataaagatgggggccccggcggggcagagccgacgccctcccacgcggctctctccgccccatgtaaaggcaccctccaggtctcatgacccggagggtgcttgacggcttggactcagccagtcatcttcgcataggggtagatgcgctccatcacgtcgtcaccgtagtgggcatccatgtactgctcccaggccgcgtcggcgggctctccggcggcccgggcgctgtagcgtgccagggccaggccgctgaccgccatattgacggacatgaaggcgatgagcagccagaccaccgctttcccggggcgcggtggaatcttggcgatccagcgggccaggatggggtagagcccccggaaccaggccaccgcggcgaagccccagaagaagcagtacagcaggttgatgcgcccgcccaggttgaagggaatagcgctgtagtcccagaacacggtgccgaacaccagctcggtaaagacgctgcacaggtactcatacaggccgcccagcagggtgcccgccacaaagaaaaaggaggccgagcggtcccggtatttgtagaggaacagggtggcggctgccagggccaggccccacacaatgctgaaggggccccataccacactgctgcggctcatccaccagcccattttgaggcggcagaagatggtttcggccagatcaccggccactccgccaataaagaacaggagcagaatgctgtaaaagctggccccccgggcaaaggggctgacggtggtcttttcccgccggcgggaaaagaccgcgccggggtgggccttctgaatgcgcccctcggcgcggcggagaatccactccccaagccggacggagagggcggccagacggctgtttaggttctccagcgggggcaggctgctgcggacgccgcagagggtcagcacggtgcccgcgatgtccgccgccagcagggccagcagcacccacagcaggatttcccccaccagcgggggcagccagcggtagagggccaggagcagaggattgatccactgtacggccgccaggcccagcacgccccacaggaggaaggagccgacacagatgtaaccgtccaggttgccgcgccggttggagtagtcccaccagcgggtgtgggtggccttctccagcaggtgaccggcgatccattccaccaccgtggagcagatagcgctgcccaggaagaggaagaagtagttgccccgcagctcgggcagacccacggtaagcagaacggcagtgatgccgtagcaggcgcacagcgggccgaacagcacgctgcggtccacatagcggtgaaggcggacggcggaaaccgccgtctccagcacccagccgaggaaggaataacagaaaaagagccataggaggggaaacagaggcacaagcatccgcctttcttttcatcaacactggtgggaagagaatctgaggattgtatcttatcgtattttccggtaaaatacaaccgatctctcataagaaaggcaggtaatttggcaatgaacgaagtgttgaaggttttgaaggagcgccggagctgccgcagctaccggccggagcagatcaccgacgaggagttgaacgcagtattggaggcgggcacctatgctcccacggcccggggccagcagtccccgatcatcgtggcagtgcagaatcccgctgtggtggagcagctgcggaagatgaatgccgcagtgctgggcaccccggaggccgaccccttctacggtgcgcccaccgtgctggtggtgctggcggccagggataacaccaaccgggtatatgacggcagctgcgtcatgagcaacctgatgaacgcagctaaggcggtggggctggcctcttgctgggttcaccgggccaaagaggtgtttgactccgaggagggtaaggccctgctccgacagtggggcgtggagggcgactacgagggcatcggccactgtatcctgggctaccgggcggacacggcccctgcacccgccccccgcaaggagcactacatctaccgggtccggtagggaggaaaacaggtgccgcggccgggccgcggaatccgttgcttgtaaaggagagatagagcatgcacacggtaaagagagtctgcacactggtcctgacgggcctgctggccctgcccatggccgcccccgcgggggcagcggccgcatccttctccgacctgccctccagtcactgggcctatatcgccatgacggaggccgcgggctatggcatcctccagggcaccggggccaacaccatgagcccctccgcacccctgacctggccccagttcctggccatggccgcccgggcctttgccccggaggaatatgcccgcagcgccgcttccggcgcggcctgggatcaggcggggctggatgccgcccggagcgccggcctgctggaggggctggacgaggccgcgctgaccggggcggtcacccgccaggatgccgcggtggtgctctgcaacgctctgccggaggaatataccccctccttctgggatcagccgattgatcccacagccctgtcgaactgggggcggatggacagcctccgccaggaggcggtggccgagctggcccgccgctgcgtcatccagggcaaggcggacggctccttcggctatgccgatccccttcagcgctgcgacggcgcggtgctgttgatgcgggtactggagcaggtggacaatagctgccgcggcgagagccagaccgtcacccttcacattctgaacgccgacaccggcgaggccctcctgcccgaccagcaggtggagacggaggtgagtacctacctgtccagcctggcgaacgggctggacgtgggctactacgtctacgactacgaccgggagacggcatcgtataccagcactgcctgcgacagctataccctgtatttccggcccatgaccggggccgagattcaggaggagcagttctgggagaaggtggagcggggcgaggccgcctatgaggactactataagcaggacttctggctcagcttccagggggacaacgcccgcaagcacatcctcctcttcggcgacgagagcaagagccgctttgccagccaggaggaggccgccgccgctatgacggccgtcaccgtgccggtgtggcagctctccggcggggagaaggtgtcctccaccctcaccctctccgtccacgccgccctggcggaggacgtgaaggagatcttcaccgagatctacaacgatcccgagcgcttccccatccacgacgtgggcggctacgcctggcggggcgactccgccaccggcgagcacaactgcggcaccgccatcgacatcaacgccaacgagaactaccagatccgcgacggtcaggtgctggccgggagctgctgggagccgggaaccaatccccgctccatctccccccactcctccgtggtgcgcatctttgccgagcacggctggagctggggcggcgacgcctgggcctacagcagcgacgattccgagggctaccacgactatatgcacttctcctacatgggagagtgaccaagcaacccaccccgggcttcggctccggggtgggtttccattatccccctcttgactgaaacaaatgttcgatatataatagagctaaagaaaaaggagagggggcggcagtgtggagctgctggacaagctgaccatcctggccgacgcggccaagtacgacgcggcgtgcacctccagcgggctggatcgggcgggccggcccggcggcctggggagcaccctggccgccggatgctgccactccttctccgccgacggccggtgcatctccctgctcaaggtgctgcttaccaaccggtgcgtctacgactgcgcctactgcgtcaaccgccgctccagcgatgtgcgccgggccgccttcaccccacgggagctggcggagctcaccatcggcttttaccggcgcaactacatcgagggactcttcctctcctccgccgtgtggggcggccccgaccgcaccaccgaggccatgatcgaggccctgcgcctgctgcgggaggagtacggcttccgcggctatatccacgccaaggccatcccgggggccgaccccctcctcacccggcggctgggcctgctggccgaccgcctgtccgtcaacatcgagctgcccagcgaggagagcctgggccgcctggcgcccgacaaggccaaggccgccatcctggcccctatggcccagatccgggatggcattcaggccagccggggggagctggcccggttccgccacgccccccgcttcgccccggcggggcagtccacccagatgatcatcggcgccacgccggagagcgacaggcacatcctcaccctcacccaggctctctacgacaagtacaagctcaagcgggtgttctactccgcctacatgccggtgtcggacagcgcccttctccccgcccggcgggacttcaagccgcccctgctgcgggagcaccggctctaccaggcggactggctgctgcggttctaccacttccgggccgaggagctgctggacgaggcccaccccaacttcaatcccctggtagaccccaagtgctcctgggcgctgagccacccggagttcttcccggtggaggtcaaccgggcggactacgaggccctgctgcgggtgccgggtatcggggtgacctccgcccggcgcatcctggttgcccgccggtgcgcgcccctcacctttgcggggctgaaaaagctgggggtggtgctcaagcgggcccagtatttcctcacctgcggcggcaagtacctggagggcctgcgggtctcccccgacggggtgctccgccacctggtggcccaggagcggcccatgctggcccagggcgcgccggagcagctctccctcttcgagcagacgggttaggaggcggccatggactggacaccggtttcctatgcctatgacggcagctttgccggctttttgacctgtgtatttgccagctacgcccaccgggaggagcccatgagcttttccaccccggaggacgggcggatttccctctggccggagcggacggtggacaccgacgaggcccgcgcccagcgggtgtaccgctccctggcccccaggctgggacaggaggggcggcggctggcggtgtacggctttctcacctgcctggaggagcgggagctccacctgtggcggtttctccgcctggggtacgaccgggggccgtgggtggtgcgggatctcaccgacgaccgggtggcagtgctgacccgcgcggtgggccacctgaccggagaggctcatctgctcaagggcttcacacgcttctccgagcaggagggggtgctggtgggggaaattgcccccaaaaaccgggtgcttcccctcctccggccccacttctgcgcccgctatccggaggagtccttcgtcctctacgaccgcacccaccgggaggcgctgttttaccggccccggcggtgggccatcgtgcccctggaggcgttccgcgccgcagcccccggccgggaggagcgggacttccgccgcctatggcggcggttttacgacaccatcgccatcgaggggcgggagaacccccggtgccgcatgacccagatgcccaagcggttctggggcactatgacagagtttcaaaacgaaacggaggagcgaaaggagcttgcaccatgaagaacgtaaaaatcactgtactgcgcaagggattttaccccgatctgatccgggagcacctcaccgagcctccggaggagtgcgtctgcgacttcttccgggagggggaccagttcctctataccgggggcgcggaaatgccagccggcttctgcccctgggcgtggatcgatctctaccgctcggtgtccgccctgtcctgcggtgcctcctataccccctggcagcggcgggagggggtcaatgtggtgtgctgtaccgacgggctgcgcccggtgaccttcctgttggaggcccaatgagaaagcgccgcccccacaatgcgggggcggcgcttgtcatgtaacggagtgctctgggatgtcctgccagcggatgcgctgggggatggggggcggattgcccttgaagtcccggtcgaaccagcggggcacgggagtttccgccgaaatggcctggaaaaaggcggtaatctgctccgctgtctccgggatggccgcctccagcagacggttgaggtcggcgttgctctcctgagccgaggggtggggcgtctccttcagggcgatgcccttggcggagggaatggggagcatgtggctcactgcaccgatgaccttgccggtcatgcggccgttggagcgggccaggaagccggagaagaaggccatggagcggtaggcccgccgcatctggtcgggggaggcgtggacaaaggcctgggacgccgcctcccagacggcgcggtcggccggggcgctgggcagtggggactgctcggcggcattgaggccgtcccgctccatcagcatccggtcatactccccctcaatggccatgtgggagatggggccgtcggcggcccggtcgtccacgtagccgtggcaggcgctgtccagggccaaatggcagaggaagccagctccgtagccggtggacatgggtacgccgtcctcgatagcctggcgcagacgctccaccgcgggcagggcggagcggcggtgcatcttgatcccctcccgccggacggcgttggggcggatgggctggtagaagaacagcgggtcggggcccagacagcccaggtcaaaggcctcccgctcctgctcaatgagttcggacaggccggcgggcaggtccgccagcacccgttggccaaacgtcaggtgcgcgtagtaattgggcatggtatggatcagcgcctccttgcacaacgcggcgatattgccttgctgaccatattatagcacgccagtcaaggggaggagatggaaaacagcccggcggagcgcgctccgccgggctggggctgtcgataaacgctcctaccaaaggtttcggagggagggatagtgtgaaaggctgccccgcagggcgattcggagcgcaaccgccgctttgcggcggcgcttggcgcggggatgaacagtcagggttccctggaggtgaattggccgcaggccaagaaagtccggcctgggccgttcgcgttggatcaaacaactttttgaaactttcctaaagtttcaaaaagttcagcagccagtcgaaaagcccttttcgactggcggagcccggcggagcgcgctccgccgggctgccgtttaaccgcccaggtatgcctttttgacggcctcgtcggccagcagctcccggccggggccggtgagggtgacccgcccggtctccagcacgtagccccggtcggccacgctcagggccatctgggcgttctgctccaccaggagaatcgtggtgcccgcccggtggagctccttgatgatgtcgaagatctgctccaccagcaggggggccaggcccatggagggctcgtccagcatgagcagcttggggttggacatgagggcccgccccatggccagcatctgctgctcgccgccggacagggtgcccgccacctgacggcggcgttccttcagccgggggaactgctcgtacacccgctccaggccgggggcgatggtggaggcgggctgggtgaagccgcccatctccaggttctcctccactgtcatctgctgaaagacccggcggccctccggcacctgggccagtccgcggcccaccagcttggaggcggggacgttctggatgggctgccccaggaactcaatggagccggtgcgggtgtggagcagaccggacacggtttgcagtgtggtggtcttgcccgcgccgttggcgccgatgagggtgacaatctccccctcattgacctgaaaggagatgtccttgacggcgtgaatggcgccgtaatagacgttgatgttcttgacatccagcatcacagccatctctcagccctcctttccgccgcccaggtaggccttgatgacctccgggttgttctgaatttccgtgggggtgcccttggcgatgatctggccgaagttgagcacgcagatgccctcgcagatacccataaccaggttcatgtcgtgctcgatgaggagaatggcaatctggaaggtgtcgcggattttgacgatgttctccatcagctccgcggtctccgaagggttcatgcccgccgccggctcgtccagcagaagcagggacgggttggtgcccagggcgcggatgatctccagcctccgctgggcgccgtagggcagggagcccgccttggcccccgccagatcctgcatgtgaaagatggagagcagctccagcgcccgctcatgggcggtcttctcctccttccagtaccggggcaggcggagaatgccgctgaacaggccgcagtggatggaattgtgcatgccgattttgacattgtcctccacactcaggttgttaaacaggcggatgttctggaaggtacgggcgatgcccgccttgttgacctgcactgtgttcatgttgtgggtgtccactccgtccagcagaacggtgccccgggtgggctggtacaccttggtcagcaggttgaacaccgtggtcttgcccgcgccgttggggccgatcaggccggcgatctcggtgcggccgatggccatgttgaactcgttgacggcggtgaggccgccgaagtcgatgcccaggtgctgggcctccaggatggggctcttatccacgtcccgctctggaatcttgttgacgctgggcaccgggaccagcttggtctcgggtcgctttatgctgctcactgcttgccgcctcctttcaccgccgccgcatggggcgcgtccgcccgctcccggtggaacagccgggagaagaagcccttcagggtgggattgttggtggccagcatgaccaggatcagcacaatggcgtacaccagcatgcggtagttggagaactggcgcagggcctcgggcaggatagtgagggcggcggcggcaatgacggagccccacatgttgcccaggccgcccagcaccacgaacaccagaatcagaatggaggtattgaagtcgaacttggtggcggcgaaggtggtctggctgcacccgtacagggtgcccgccgcgcccgccagagcggcggaaaccacaaaggcgatcatcttgtacttggtgacgctgatgcccacgctctcggcggcgatgcggttgtcccgggcggccatgacggcccggccggtgcggctgttgaccaggttgaagatgaccaccagggccaccagcaccagtacaaagccggcaataaaggtggagatgcgctgggtgttcatcacgcccatggggccgcgtatgagctccaccccgccgtcggccagctcgtttttgttggagaggaagctgaactggaggccgttttcatccacgcccaggtagacgttggtgatgatgctcttgatgatctcgccaaaggccagggtgacgatggccaggtagtcgccattgaggcgcagcacggggatgccgatgagaaagcccagcgcggcggcgatgaccgcgccgaataccatggccagggccaggcgcaggggggaaagggtgacggtgctctggagagccagggccagggcagagccggcaaaggctccaatgctcatgaaaccggcgtggcccaggctcagctcgccggagacgcccaccaccaggttcagggccagcgccatgacgatgtaggcgcagatggggatgagctgcccctccagcatggcgcccacgccagggcccatccgcagggcctgcaccaccacaaaggccgcaatgaccagcgtgtaggtaaacaggctgtttttggtggattttttcatctgtccaagttgtctcatcgcgtccacctcacactttctcacggacggtcttgcccagcaggccggcgggcttcaccagcaggacgatgatcagcacaccgaacacgatggcggtggacagctcggtggagatgtaggcgcgggcaaaggtctcaatgacgcccagcagcaggccgcccagcagggcgccggggatggagccgatgccgccgaacacggcggcggtaaaggccttgatgccgggcatggagccggtggtgggggtcaggctggtgtaggtggacaggaacaggacgcctgcgatggccgccagggcggagccgatggcaaaggtcatggagatggtgcggttgacgtcgatgcccataagctgggccgccgccttgtcctccgagcaggcccgcatggccttgcccatcttggtgcggccggtaaaggcggtgagggccagcatgatggccacgcacaccaggacggtcacgatggtcagccaggagatggagagctggccgtcaaacagggtcagcttggcggacgggctcaccacgggggtaaataccttggggctggagctccacaggagctgggccgcattctggaggaagtagctcacgccgatggcggtgatgagcaccgccagggaggtggcctgccgcaggggcttgtaggccagccgctcgatggtgatgcccagcacggtgcacaccaccatggccagcaccgtaccagccagggcgggaaccaccagcgcggccaggctgcccggggcgaagagggaggacagcccgttcatgctgaaaaagcagatgtacgcgcccaccatgatgacatcgccgtgggcgaagttgagcatcttggcgatgccgtagaccatggtgtaccccagggcgatgatggcgtagatgctgcccaggctgatcccgttgatcaggtagttgaggaagaccataacacacacctctctgtcatggatgattgcggccgggcaatggcgggccgttgcccggccgcaatcatccatttgttctgtgtaagcagttggcgggagggccgccggccgtgccggcagccctcccggaaccgtgttttgtgaacgctgggactggcgatcagtccatgcccacgtaagcgccgttctcgataaccatgcccttggggctcttggatacctcgccggaggcatcccaggtgatgccggcgccgtcgccagtcaggccggtcagggtaatggtggggaaggtggcaatcagggcgtcgcagagctcctcattgctcatgtcgggggtgcagccggcggcctccagggccatcttgtaggcgtagacgcagtcataggcgtcggcggcaaactggttgggggtttcgccgtagagctcctggtacttggtcacgaagttgacggtggcctcgtcggtggcgtcggcgttgaagggggtcagcagcatgacgccctcggctagggaggcgtcaaagccgtccatggtcaggatgccgtccatgccgtccacgccgaagaaggtgggggtgtagcccatggcgtcggcctggctcagaatcagggaggcgggctgataatagatgggcaggaacaccaggtcggccccggcctgctgggcctgggtgagctgaacagagaagtcggtggcggtgtcggtggtaaaggtggcgtcgcccaccacctccaggcccagggtctcggcctccttcacaaactgttccttaatgccggtggaatacacatcgtcatttttccagatgataaagaccttctcacccaggccctgctcggtgatatactgggcggaggccaggccctggttggggtcggagaagcacatctggtagacgttgtccttgccgctgatgacatcgggggagctgccggagggggtcatggtaaagatgcggtcctcaaaggccagggcggaggtgctgacgccgggctgggaggtgacggagcccagggagatctgcatgccccactccttcagggcgttgtaggcgttgaccgcagtctcggggacgttcacatcgtcctcgtacttcagcgcgaactgaatgtcgccgccggcctctttgatttcatccacggcgatctgggcgccgcgctgggcagccaggccatagatggcggcgtcgccagtcagagggccggtgccgcccagcttgaaggcggagccggtgttctcctggacggtgctggtgttggccgcgtcgggggtctgggctgccccaccgccgtcaccgctgccgccgcagccggccagcagggacacgcagagagtacccgtcagtgcaagagacaggaagcgagtctttttcatagtggtatcctcctttgaagttgttgacaattatattctgtgcacttgaaattgtcaactagcaaaatacacaagggcggcctgtgagagaccgcccttgtgtaaaatatgaacaaattgtgaaacggacacttaaattaccagcccgccgttgggggccagcacttggccggtaacaaaccgggcggcgtcggaggagagataccagatagcctccgccacgtcctccggggtgccgatggcccccaggggggtctcctccgccagggcggccagggcttcccggtccagatgggcgttcatttccgtggaaataaccccgggagacacgcagttcaccgtgatgcccgaggggcccagctccttggccaaagcccttgtgaggccgattactgcggcctttgcggcggaataggccacctcgcaggagccgcccacctgcccccacatggaggacacggtgacgatccgccccgccttgcggtggatgaagtggggcagggcggcccggacggcgtgaaacacgccgtccacgttgacggcaaacatccgccgccagtcgtcatcggtcaaatcgccaaacaatttctgctgtgcaatgccggcattgcatatcagaatgtcaagttgacaatatttatccaacacattgtcaaccattcttcccacttggaccggatcggccacgtctgcctgcaccgcccagcccccaatctccgccgccagggcctcggcctgggcctgggaacggtggtagttgataaccaccttacagcccccggcggcaaagcgccgggcggttgccgcgccgatgccccggcttccgccggtgatcaggaccaccttctgctccatcatcctcttcctttcagccagtctatgcacagcggatgccaggccgctgcgtgggcgttatagtgggcctcgtcccgggcgctctcccggtcggccagccccatggcgtggggcccgtcctgaaacaggtgcagctcaaagggcacctgccgcgcccgcagggcgtgggcatagtccagggtattttccaccggcaccgtggcgtcccccaccgtggcccagagaaaggcgggcgggtggcccgggcccacccggcggtccggccgcagcacctccgccccgcccaggggttccagatagagggcctcgtgcaccaccggatagcccagtatggccgcgtccggccgcacctgctccggcgtcagccccagccgctcgttcaggaggggctcggcgtacccgccggccaggcagcccgccagatgtcccccggcggaaaagccgcacactgccacctggtcgggccggaagcccagctccggggcgttggcccgcatccaggccagagcggccgccccctccaggaattgcctgggccagagggcgggcagcacactgtaggacagcacaaaggcctgtatccctgcggccagaaaggccagggccaccggctctccctccgccggggcaatgcgctcgtatcccccgccggggaggatcagcaccgcccaccgcgccccgtcgtcggccagcaggccggtgcggccccggcagtatatgtccagccccgtctccggggcgcccccgcccagcgccggatggagctcatccagagagacccgtcggcagagcatgcccgccacccctttccaatccactttgatccgagtataccagccggtttcccctttgaaaaggggaaaatcaaaaaaagtattgacaaatagagcttgtacggatataataatctacgctgtctggacgattagctcagctggtagagcatccgcttgacgtgcgggaggtcacaggttcaagtcctgtatcgtccaccagaaaaaccgctgttttcgagagaaaacagcggttttttgttacttttttattcattttcttcctcacgctattctgtcaaattgtttttgaccacataacagccacagacaggaaaaatcgacgccctccggaattgcttttccggagggcggttttctgttctcagcaggctttttccctggcccgaaggggctccagctcctttttcatctccttaatcagctctgccagtttctgctcacattcttcctccgtaggagcgtagacgtttcgagcgatgcgctttccatcgaccttcggggagtaacgcccttcccagaggtggtcgttgatttgggtcatacacccggttcccggcttgcggtacttgccctttaccgcccggaagggcgtgggtgtcgtttcctttttccatgcgggttttgagggtggctccacaccggcgatccctcggtcgatgtgatcagcagccttttgtcgcatctcgtctgtcacatgggcatagacattcagggttgtggcgctggacacatggccgatgatggcggacagtgtcttgatgtccatgccatgctccagggcgttggtggcaaaggtatggcggagatcatgaaagcggacacgcttgcagcccgcccgttccaggacagcggccagtttcttccgcaccgccgccggatccaagggagaatccgctttctttggcgaggggaacatccaccgagagatacaggttttccgatactgtttcagcactttcagaagcggtgcgggcaggatgacactccggctggatgttctggttttgggctcggagaccaccagttctcctctgatccgctgtacctgccgttccaccctgagcgctccggtctgaaagtccaggtcatcccattgcagggccaggatttcgccccgccgcaggccggtggagagctccagcagaagaagttcatagcatccgtcctctttggcctgaatcagcagccgctggatttcttctccggtcagtacagacatttctctgggatgggtggctggcgctttgcagtttgcagctgggtttttcagaatcaacccatccgccaccgccttgtccagcgccatgcggcaggccacatgacagcttttcaccatacggtcggacaggccagggccgtattgctccgcccgcagaagccgcccgccctgcttcaggcggtggtaaaactgctggaggtcgctttgggtaagctgagaaagaggggtgtgtcccagctccgggatgatgtgctgatagatccggttttcatagtccgcctgggtcttgggcttgatggccggtttgcagtacgtctgataccagcggtccatccatattccgaaggtcacttctcccctggggcgctccagctctaagcctttgaggctctctttcagcgcttttagctttgccgcacactctccttttgtctttgccaacacatttttggttttcggtcggcccttctcgtcatggcccaccacataccgcccctcccagcggccgtcctttctcaggtggagactgccatctccccgttttcgtttctttgccacggttccaactcctctcccaatagttcggtcagaaagccgcctacgatctcagcggcgccgcgctgcatgtccccggtcacatgggtataagtatccagggtaaagctggccttggtatgccccaggattccagagagcgttttcgcgtccaccccgctggtcagggcatgagtcgcgaaggtgtggcgcaggtcatggaaccgaagatcaggcagcccggcctcacccagtaaactttttaacctccggtatgcgctgcccgggctgaccggccgctccgggcagagaggatcggggaagatccactctgtcagggcagacttttttcgctccctcagaagctgggctgtactggacggaagcagaattgtccgggttcctgcataggtctttgtgcttcccgcctccactccgccgcccttcctggcatggatggtacggcatacttttaatgtcccggcctcttcatcaaagtctgaccacttgaggccacacagttcgccccgccgcagtccggtagtcagttcggtgaggaagaagtcccgccagatccaatccttttggattgctgccttgaatgtgtccaactgagcgttattgagaatcccctttgccctgttgaccaccttaggcggtgtcgctccatcggcagggttggctggaagcaatccctcctctgcggccgttctcagggcgtgatgcagggtggtgtgaatcccgtggacagttgtcgggctcaggccaaagcctgaggctttcttcctcaccactcgtccgcgctccagaagcgcttgatagagttcactcaaatctgccggagtaattttgagtagcggcttttctcccagatagggtttgacatgattgttcagatccctccggtacccatccagggtactctcccgaaccgttcctgtcatgtacgtatccagccacttgtctagccactgggataaggtcattttgctctcctcggtcagatccacgccctgataggcgttgatattctgccggagcttggcagtcagttccttttgggtgtcggcatagatgtagcggaagatggagtcgccgttttccttatgcccgatgacgatgcggccctcccagcgcccgtcttccctcttccgcaccatgccgtctccggatggccgtctctttgccattttgcttcacccccaaagtcgtatttttgttttgcggcgcaatttctgagcccttattttgcagcggggaatctgtgaggttcggctacgcactggtagagcacagcaccgcagcggcggcaaatcagatactgcagccggttgccccgcaggccgtgttttttgaaggtcaccagcgcctcgccgtgctgccagcccagaccgatattcgtgctcccacagtattggcattgctgaacgggaaactgtatattcattacgtttgcccctcctctttcagttcgagccggatacgctccacctctacctcctggagcagccccatggccagccggaacccggcttcgaagctggcttgggcaaggtttgctttcagttggtcttgcgcatccaccaggcgcatcagctcccgccgctgcgcctgatccagacagtcccgcacctcctgacgggtgttttcaatttcttcctccagctcgctgaagtccgtggcccggaagtagcgccggtacagttcgctcatgtagtagcccatgtgtgccgcctcctttgcagcaacacacaataccctaatcttagaggaatagccagtggttttgaccacagttatcaaattgttatcatttgcaggggactttctttgttatacactgtattaaaatcaccccgcgttttcgatttgcaactataaaattcttatgctacaatgcagatgtagccttactttacgacactttagggaggggcaggtttacatgacagatggtaaaatctatgcgatagacgaattgagagcattgatatcccctattgccgcccaatatggtgtagaccgcatcttcctttttggctcctatgccagaggacaggccacagaaaacagcgatgtcgacctgcgcatagacaaaggaaatgtgaaggggctgtttactttgggggcactatacagcgacctggaagaacggcttgggaaaaagctggacctgttgaccacgggtagtctggaccagcaattcctcagtcatattgcgcaggaggaggtgctgttatatgaccatacccaatcgtgacatccagatcctacagaagatccaggggtactgtgatgacatcatgtttacccatacggagtatgaccgcaactacaacaccttttgcagcaatccgacctatcggaacgcgattgcgctctgccttttgcagattggggagttggtgaagaaactttctgatgaatttgtccagtcgcataccacaataccgtggaaagcaattcgcggtatgcgaaatgtagttgctcatgagtatggccatattgacattgatacaatatgggagacctcggagaccgggattatagaattacgtgacttttgtgcggcacagattcgcctgcagcaagggcaaaattcattttccgacctgaccatctcgtgacaatagaactggggcctggagcccaacaacagcgacaagaccgcagctgcttcattctgcaattactttgctccccgccataactggcggggagttttttacctctacctcatggtcataccacccatcgtctgctccacatggtcatccggtctgtggcccagggcgatccgcttttcctggagcgcctgcagccgcttatggtcaatgtgcagtccggtgcttgtggaatcctccggcacattgtcccggaagatgttgcccatgtggtgaaggagttgcgtggcagagagcatcaggctgggcggtccgggcgggccctgctccatgcgttccttgaaaaactgtgcataggtgtgcccctgcattgccgcagcttggaaccagccataggcaacctcctgatcctgttccaccccctcccccatcaggtacagcttgcccaacagatactgtgcccaggggttctgtgcctctgccgcctgatgaagatattccgccgctgtatttgcgtttttgagtacatgatctccttggagatactcctttcccagagcgtaggcagtatagtcgttcccgttttgcgcggctgcgttcagccatcggatgccttcgctgggatcgcacacatctgggtcgtctgagagaagcagttttccaagcgcatactgagcctgaggcagttcacgctccgccgcctgctccagccagtgcctggccttctctgcatccggaatcagcaaaccgccgtcccggtacaactgtcccaggaaggtctgggcgtatgggtcgcccatctttgccagcagttccagcctctcggcggcctcgtcccggtcttccaacggtagcgcctcgttttcaacaagtctccacaactcccgacaggtccaggtgagtgatcgttcattcacccagtcaccgtagtcttccatatctctgtcctcgaaagagatgtggttcagccggacgtgctcagcctcctggatcaccgcattcttgatggcacggaactctttctgctcagagagcggcgggcgctgccgctccttctcagagtagtagtcattcactttgcactgcagttcccaccacttctggtagcacctatccacaacaggcaggtgttccatctggtttacgatctcatcgacctgtcgctttatccgctttggaagatagccataggacttcttgccctttacctctccaagctgctgggcaagattcaagatcatccgctctgcttcaggatgctcacagactgattcgctcatctgccgggacagttccagcatggccttccgggtctcccgcaccagttcgtcccggctttcagacttctgctcatagaggtggagcatctcctgtttgaagatctgattggtgagggctgacttgatctgccggatgccgtccctggataggtaggcctgtccagggttcgccgaccacgccatcatgtgcacatggggatgctccccttcattgtgaaaggcagcgtaccaccggaagtcctggggcttgatattcatggcggcggcgatatcgttgcggtgtgtacgcaaaagcgcacaccacgcctgggcgttatcatagcctagacgtgcggcgtccttccggtggagggagatgatgtgtgtccacacatttccagtgtagtgctccagttccaacatggctttgtccagttccacaccgtcctcgtctccgaacagcccgtggtcacccagacgctccgcacgtggacgggtggcgatgtacttggcgtagccctccgaggattgaacctgggaccagttctcctccagtgccagagtgatgagggacgaggcgttggctttcgtgggatgctgtgcgtagtcctcatactccagcagatttttcgtgtcaggaaaatcttttaccagttttgtgatgagctgctcctgcttgcgtgtgggcggacggtcatccggaatgatctccacccgttcccgcgttgcgatgtacttcatgtagccgcctgcgctctgtccgccgccgcacttgatatacgggctcttgacgatcagtcttgccatgggtcatcctctagctcccgcagcttctgtaccagcgacaccttgccattggcctttttcacgttggccacgctctccgcccgctgacggcgcagctcctcctcactcacgttgacacacttgaacagcatactcagtcccatgtccaactccaccgcctgtttgaagagcagcgacgccatacggttttccatctggttcagcctgccatccagataggactggacggcggagggcaggaacaatccggagttgttggcgctgagatagtccaggtagaagtcgatggcgttttcgataaatccagtgatgctccggctgccatcttccgtatgcctccgctccagtgtcgcttttttctccggcgacaggtagagggggaatttctctttcgggctcataacagcctcctttccggggcttgacccctgttttttccttgtgggagtaagcgtttggggataacgaccgcaagatttcctgttctctctgattttgaccccatttgcaacgcctacggaaacctcctgaaactgcccgcactgcgggcagaagtgattggaaaaggcgtcgatgttgacgccttgcctttatcccgctccttctttcgtccctcgaaagcggcctaatccgtccccaaagcccccaggtggggctgggctttgctctgcccagaaggagggcacacagcgcctcacagccgggcacacgggcgttttacgcttccaggcgaagcaactgctgttgatagcaataatccatcgccatttgtattggcaggatggtgtagaggttattgccgttccacttcataccgcgtttgtcaatgtagctggtgctctccaccgtgatgaactgcctgtccgccaacttcgtgatgtgcttcatcaccgtggacacggtaagatgtaccacatctgagatcgtgcggtagctgggatgacactgatgggtacgacggtcttcacagtagagcagataggcgtagacggtgatgaccccgtgaccgatgttcaggaagaacagctcattgggcagagagaaaaaattcttgctggtgtttttgaagacgggaaccatgtgctgatccagcagcccgcgatggttgagttcagagagctgctctgcggccatgtctttgctcatgtgcagttgggatgcgatttcatccgcactggatgaggcacctttgttgcagtggatgtgcagatagcagagataagcgagggtcgcaaatccctgcggcttgagattccacttccagatgtcattgggaattgagaaacgacgctggttcatttgtgctcacctccctccgtgtgctccgtgacccatcggatgaattgttccttgggcaccaccatgcggctgcccacacgcagtaccgggaagcccggttcgtgcatgagctcgtacccgctggactgcgacacgcccagcacctgggctaccagatttgcgttgagaaacagcggtaactcatcataacttttgtactgtggcgatttcattgtgatcctcctcccgattgacccgagtgttttcatctgatacacttgcgttgtggcgacagggtaccataggttaacccttaacacaatagaattagggcgcattgggaaaatctcaaatctccatcggttacaaagcggagggagttacatggacaatcagacacaggggatattcatcccatatacctatacctacgaccagtttacagtgttcttttatggtgaccgggtctttctcggagaaaagagcctccctaccggacagtgcagtgtggatattttgaaccttgatgaagaaattttgatgaaaatctatcagcgggtgcaggacttcctgcctgcagctcaacgcctgctgacagaaaaaacagacatcgctgtagtttccgctcaggagaaactaaacgctgtctgggatgtcgtatttactttgcctgggtatcgggatttgcaaattgacagggaatgtagttatcacgccctggagaatcttctgacagagagcgacaaatggatgcagattcaaacgcccggcacagagggatacactatgtatcaggagttcatggagggcctatctagtcttgcggcccgcatccgtatgttccagggccagatcgctactatgaccgagttctactttgagccgttgacgcgacgaaacagcgcggcctatgcagacgcctattctaagttctatagccagatggcctccatcgcggcacattattttaacgaggattttgaccagagctttccggtggaggtcagtttcgttcccatgatgcaccccacagaagagggcaaagtgtttgtggccgaaaaaaccacgttcaataatctgctggattttttgcggaccgaattttaccgggggcttgccatcggcaacgcacctcgccgctgccacaattgcggcaggtattttttgctgaccgcaggctacaacacctgctactgcaacaacattgcgccgggcgagacggagcgcacctgccggaaggtgggcgctcaccgaaaggaggcgcagggcaaggccaaccgcacgcctgcccaggtggagtatgaccgcacctataaccggctaaagcaaaggaagaaccgaaagaagatcagtatcgacgagtggaacatcgctgtggcgaaagcacaggaacttatggagcaagccggtcgtggagaactgacggatactgagctaaaaaggcaactagagttgctctgataaaccatctcacaaagtatacctatcaccccacgggtttcttctatatggttaaacctgattgatttttatctttattgcgtgttatcgatatagctagtataataataaataattgactggcagaaggaggaaacgggatggcacaatatttgcgtactgagttagatggtaatatcgaatatgtcagccgtattcgtgcacagtactcttctctgtcaaaaaaacaccgtcagattgcaaattacattttcaagcatcagcaagaagttattcattactccatttcgactctggcaaaaaagaccaacaccgcgccgtctactattacccgtttctgccaaatcctgtcctttaagggcttcagcgaactgaaggtgtacattgaaaagggccttatttcggcttccattgtagatgcacccattcaggaggcggacaccacctccgtcattctccagaagctgatgaagagcgcccaggatgtgatcacagataccctgcgtgtgctgagtgtggaaacggtatccgccgtagccaaggctatcttccaggcccccaatgtaaatctattcggtcagagcggtggctacatctccgctctgtatgcccagcagatgctcctgcgcgtggggattcgaagccaggcttttaatgataatgtggatatgagcatcgccgccagtaccatgagaaaaggagatgtggctatcggatttggctatagcggagaaagtcgttccgtgattcacgctctgcagaatgccaaagacagcggggctaccatcgtatctataaccgccaatcccaattccactttggaaaaattagcggattatacgctgctatatagctacaacatcccagacgacctgcagtgcctccatctgggcagtatctgtgaggtggctattttgggcgtactgcaggcggaaattctccaccagcctggggctaaagcgcgccttgatatggtcaaggatgctgtactaagcagccgaatccgataaaacccgaaaaatggtgcggcatcctgcctatagacaggatgccgcaccatttttcaacgttgtacccggccggacccatctccagccatcagcttttccacatctgccacacttacccggttaaagtctcccagtatggagtgcttgagacaggaggccgccaccgcaaattccagtgcctcctggtggttctgataatgagtcagtccgtagattaggccggcggcaaagctgtctccgccacctacccggtccacgatatcccggatctcataccgcctggaggtgtaaaatttactgccgttgttcagacaagcggaccagccattgatatccgcgctcacactctcccgcagagtgatggcaatcaaacgcaggttagggaattcacggagcacctggtctcccaatgcccggtacttctcccggtccaactggcctgcagtcacatccaccgccgccgagatccccagcgatttctgcacgtcttcctcattggcaatggccacatccaccgattttgtcagttcccgcatgacctgaggcgcctctttgccgtatttccaaagatttttccgataattcaagtcgcaggaaacggtaacaccccgggctttggcctccctgaccgcacaaagggacagctccatagcgctttcagaaagggcaggggtgatgcctgtgatatggaaccacccgatcccagcaaaggcttgatcccagtcgatctcgctaggtgccgtctgggcaatggcggagcctgcccggtcatacaccaccttggaaggtcgttgattggcacccgattccaaaaaatagatacccatacgcccctgccgggtgagaatacggctggtatctacgccgaaccgccgcagctcccccatgcaagcggaacccaccggattatctggcaggacagtcaaaaaggcagcatccacaccaaaattggccaaggagacagccacattggcctccccgccgccgaaggttgcctctagcgttccattttgaaacaggcactcgtgcccaggggacttcaggcgaagcatgatctcgccaaaggttaagtacttcatctgaaccactccattctcctgtccctacaggccggcaaggatattcttggcctgccggcacagttctgtgatgtgttcaaaccgtccctgggcgatatcggagcggctgcacagccagctgccgcccacagcccgcacaaagggagctttcgcatattctgccagatttgcggcgttgatccctcctgtgggaacaaactgtagccccacaaagggaccggagagggctttcattgcctccaaaccaccgtagatgctggccgggaaaaatttgactgtgctaattccccgcgacagtgcttccatgatctcactgggtgtgacgcagccgggtaaaacagtaagctcgtgttccaggcaccagtcaaccacacagggatcaaagccgggagaaacaataaaccgagctccggcctctgccgcctgcctgcactgctccaccgagcacacggtacccgctcccaccagcatgtccggacactgttccgcaacgatttggatcgcatcccgggctgcatcggtgcggaacgtaatctccatcacgtcaatgcctcccgccaggagagccctggctgtggaaagcgcctgtccagcatcttctaggacgaccaccggaacgacacctgcatttgaaaagcgttccatcagatccattatttttcgcctcgcaactttatttttatgtccacaggtcaggcatcctgccagcggatttccttttttacccgtccccagccgctggccgcagtctcagctgcagtctccgccaggccgggcagggaaaggccaccgtcaatggcgatgctctggccggtgatataggaagccttgtccgaggccaggaataccaccagattccccacatcctccggtgtaccataacgctccagcggaatgcgctgggacagataggccaccttttccagatgggccgggtctgttttggcttcttcctccggcgtaaagcgcttggtggcgccgggcagtatgttgttcgcccggatcccgtaggaggctacgtccagtgcaacggactgaacgatccggttaagggccgccttgatgccgccatagatagcgtcgcccgggtgagcacttaggccacgggtggagctgatattgataatattgccccgggttccctggttggccatataagtggcagcctcccgcatcatcagcacataggtacgcagcatcagattgacaaggtaatccatggtctcttccgtcaggtcaaagatactttccagcttggtgacgccagcattattgaccatcaaatccaacccgcccagccgttccaccgcctgtctgaaaaaggaaacagcagcaccctgctcggtcagcttagcctgataacagtcaaatatgccatccggatactggccggccagcgtctccaacatatgctgggcggaatcaaaatcggtgttataggaaaataccacatcatagcctgcctcagccaggcaatagacgatcccccggccaatcccgtgactaccgccggtcacaacagctttcttccgtctcattcagcatccttcctttccctgcactggtgctttatcctctggaacctgggcagcaaaggctaaaaacaccaaaaattcttcccctgtgtttgagatggagtgggtatcccccgccggaatgaaaattgcatccccatcccggatggattgccgctcaccatttatggtcatggtgccgtggcccgcaataatgtaatagacctcctcatggtctccatgggcatgggcctcataggacttacctgtctggagcatggcataggctacatacagcatgccccgcatgcagtagtttggcacatcgggggaaaaatcggcctgacccttgagtagcttatagtcgatgccgtactgatgcacgatggtgggcgccgcctggcgccagttggtaatgaccataatgacctcctgtctgtttcagagcacaaagcgctctgtccgcagcccggtcaaaatttccgggccctccgatgtgaccagaatctcgtcctcaatgcgtattccgccgacgccaggcacatagacgcccggttcgatggttagtaccatattctcctccagacatccctggacgccagggacaatagcaggtcgctccacgctgtcaatgccaatgctgtggcccagataagggttgaaccatgtctcaaacggatgccctcggagtacatcgaaggctgtgtccatcagggactggagggaaattccagggcggatcctattgatacaggtccgctcgatccgccagaccagctcatacagagcctgctgctcccgggtgggctgtcccagcataaaacttctggtccagtcggaggcgtaattccccactgtggttccaaagtccagcaggacgatctcgccctgcgccagctttctggttccgggcaggttgatagtccgcagggcgttgtctccagagagcaccttcatggtaaacggtgtaccctcagagccgtttttccgcataaaatattccagctcggccactacgtccagttcggctaccccgggacgcaggatgtcgcaggcatgttccatggcctccttggccaggttggcggaacggcgcaggccggcaatctccgccggtgtcttcttcatccgggcccgataaagccgggaggtaacatcccacaggctcgtctccggcagttgctcccgcagcgctagatagagggggaggatgatagtttcttcttcaaggcccagccgctccggcttccggggcagagcccggcataccgcttcggccagggccgcaggcgacgggtcgcaaggaatcagcgtaatttggctgtccagctgcggccggataacgtcgccccagttcctgggacagaaaaacagagtgaactgctcgtccatcagcacacactggttaccgatctggttgggccgtctggccgtggtataaaatcctgtagtataaaagattgcctggggtgaagtgagcaggacgggaccctgctcgccaggaaagatctcttccagtcctttcacgctgtatcgcctcatttctgttccgccgtccggaatcaccaccacttgatgcgctctgtcacccggtttctcaggtcaatgaattccggagccgcgatatccctaggtcggggcatattgttatccaccgtctccttcaccgtggtgggtttgttggtcagaatcatgatgcgctggcccagatagactgcttcttcaatgttgtgggtaatgaaaataacggtggttcccgtcatctcccagagcttgaccagttcgtcctccagcttgaagcgcaattcgatatccaactgaccgtatggctcgtccatcagcagcagctccggctcggtggcgaaggcccgcgcaatggacacccgctgcagcatactggaggagagctgcttggggtagtagttacggaatttggtcaagcccacaatatccagatacttatccaccagttcatcccgctgcttgggcggtgtgtgcttgatgttcagaccgaaggccacgttctgcgccaccgtgagccagggcatggtggagtcgccctgaaagatgtaggcgatgttgctggtctttgcgttgactggtttcccgtccatcaagatctgtccggccgtcaggtcgtaaatatgggtcagacagttgaggaacgtggtcttaccgcagccggtgggccctaccacgcacagcagctcgcccttatagacgtcaaaggagatctgatccagcaccagcagatcgccgaatcgcttggtcagattgtccacatggactttcacttcccgggtctctttgcccagttccatagttctgcctcccttacatggtcttgtccacgatactcgtaatctctttccgcagcgccagaaattcgggagacacgtagttgcggggacggggcatatcaatgacgtattccttcttgacggtggccgggcaattggagatcacaacgatcctgtcggccagatacaatgcctcttcgatgttgttggtcacaaaaacaatggtgcgccggtcagtctgccagattcggtccagctcctgctgcatcaggtagcgggtctgggcatccagtgcaccgaagggttcgtccatcagcaacaccttgggctcaatgcagtaggaacgggcaatacccacccgctgcttcatgccaccggaaagctggatggggaaggaattctcaaatccgtggagccccactaggtcgatatatttctgggcccgagcgcgccgctcttttttcggcacaccggctactttcagaccgtactcaacgttgcccatggtggtcaaccaggggaaaaggcagatgttctggaacaccacaccccgctcgggaccaggcccctttaccgtctttccatttacgattacctgtccgctggtcacggtctccagaccggcgatcaggttgataatggtacttttgccgcattggccgggaccaaacagggccacaaattcatgctctctggcggtcaagctgaagtccccgataacctggaatggaccagagggtgtttggaaggtcttactgacatttttgcactcgattatgttccgctcttgttccaccgacatagcacagcctccacctttctgaagataatcgacagaaccagacccacaatgccgatggccacgatacccaccaggatctggagcatgtcgttgttgttcatgccggcaataattacccagccaaggccattagaggagcggaccatctcggcggccagcaccgtggcccagctgctggagagggctacctgcaggccggcaaagatggacggtacgcaggccggcagaataatagtgataaagatctgatgatccctggcgcccagcatacgggccgcacccaccaactgctgatccacatttttgactccgttccaggcgttgagggtgacatagcagaaggaggccagaaaaatgagaaatattttggcatcctcccccagcccgatccagatgatggagatggggatccaggcgatgggagggatgggccggatgatgcggaacagcggggaacagatggcctccaccattttataggtgcccatggccaagcccaggatcacgcccaccacagagcccagagcataccccgccataacacggagcaggctgtagaaggcgtgctccaccagggtgttttgaccgatctttccactgaccaaagatgtaaaaaatttttccagcacaggaatggggcccggcagcattttgcccaactcaccctggaccgcaatgttccagagcaccaggaacgccaggatggacaccgcgccgcacaggaaattgatacccagcagttttttctttttcatttggcgttcatcccctttgcaaccattttctccacagcctccaggattacatccagcaccagtccaaccacaccgatgcacagcatgcccacgataatcaggtcagggcgagagatcaaccgggcgttctggatcatgaagcccaggcccttgctggacgccagcagttccgcagccaccagggccatccagctgccacccaaggcggtacgcaggccggtaaagatcataggggtagcggagggtatggcaatcttgaacagcttctgtgcgttggatgcaccgaacacatcgcccagccagatatgttcctgtctggtctgctggatgccggtataggcgtttacggtgcaggcaaccatggagttgataaagatgaccatagcctttgccccgatgccgatgccgaacagcacgataaacaacgggatccaggccaggccagggatagggcggattaggtcaaacagaggccggatgaaccggtcgcaccatttgttccaggccatcagaatacccatggggatacccaccaccgccccgatcccgtagcccagcagacaggtctgcaggctggtgatcgtatgttgaagcagagtggcgttatccggattgcgctgggtcagcttctggataaatgtagtcagcacctttaccgggcctggaaatacagtggtctccgtcattttaaacacgtcgcaccacagaaaccacaccagaagcaccacacagaccgaagcgcaggagataaaaaagtaccgccgtttttttagaaatcctttcatggaaacacctttcgctttctgcgcagaggcgccggggagatactgtccgccccggcgcctccaaaccgcttagtgggaattatggtagtccagaatctcggtccggtaagtctcgtacttcagggaatcggtgatgttggacaggctgtccgcttcgatctggccctggtcgatgaagaactgggccatggtgcgcatggtggtgccgggctcaaagggaggattctccagctcttcccatgtccagtaggtcacgttggcgatctcggcagccatatcctcctcgctgtaggtcacaccgccttcgttcaggtagagattagtggcatactcggcccgcagttcatcatccttggccaactgatccatggcttcaaagcagcactcggcaaaggccaccaccacatcgtgatagttttcgtccagctcgttggtcaccaccaaggagtccaccagaggcgcaccgtccatcaggtcgggcatgtccgccaccatcacatagttgggatcggcatccagcatgctggagtagggcggcgtagtggagagaatgtcaccctcaccggagatgaaagcctggtagccctgggcatggtccatgttcaccagattcacgtcttctgccgtcaggcccatggcctcagcataggcaatagcgttatactgggccgtactggcaaacaggccaatcatggtggcacccttcacggtgtcgggactgccgatcagattggtgccgttgtagttgccggccttgacgatgtcgctgtccgcccgggcatacatggactggccgccggagttgatggtggtatcaaacacataggtgaaacggccggtacccaaaatgtacacgctggccatgccagagcaggcaatatccagctcaccggcagtcatagcctcgttaatggcggggccggaggccagagtaacgacctccacatccaggccagcgtcttcaaacagacccatgtcacgggcatagtacagatacaggctggtctggcggatttgaccgcccactttcaaatgaattcgggacaggtcgccgctgtctgcagagccgccggaagccgcgggatcagtggaaggtgtagtattgccagagctgccgcaggctgcaaggctgatcgtgagggtcagggaaagagcaagagacagtgcctttttcagcgttgatttcatttccatcatcctttcgatttctattttactatgggggatcccacaataaacaaaacggtacagcccttacggacaggcgccagcaggtgaaagtatgacatccgcccggcgcatgatctcaaaacaggttctggagttgtggtagggacactttccctttcctgctagttcgttattattgaaaacttccttcagctgatcggcctgagccctcagttccgtatcatcacagggcggcagaccgacggaataccactctcctaagtcgtggttgaccacatagcgctccacatagttccagatgtttaccgccgcgtccagatagcgccggtcacccgtaaactggtaacagttaaagctagctgtgatcccttccgcctggacccaccagatcttcgcacggttgatctccccgctggcgctgtcgccgatatagtacagtcctccgtattccggatccattccttccgccagaacgtgatccatgaggtccactgccgtctcccgggccctccggattaaatcagcatcacccaacagttctgccgcgccggtcagcagataagagcactccgcgtcatgtccgtaattaatctcatgatccaaacgtgctcccgacacatccatcgccgccttcaggtggtgcagctttcgatccacaaccgtaccgagcaaaaactccagttcgtcccgcagactctgcaggatccagggctccggcgctgcctgagccagattgtatatggcctcaaacaaatgcatgttggaattgagcagcttggccgcaccggttctgttcttgacccagaaattgatccagtcgtcccgcaaccagtcccgagcggcagaatcggcgtaaccgccctgaggatacttcatgtgtcggttcagtagactcagcacctgccgggcccggtccagcgcctctttagaaccgaaaacccgatagtattccgcataggaatagatgagaaatgcctgagcgtatgtgcgcttttccagctcagaaggctccccccgacaggtcaccgcccaatagacaccgccataaagttcatcccaaaaatgggactggatgtaccggaaggcgcgctgggcaagttcctggcaggccgggtaccgcaccatatcccatgctctgctgtaggtccataacatccggccgttcagcaccatgctctttggactactgagatccggctgcaggctgccgtctacccggccataaaacccgccatgcacctgatcagtcatatatctggtccaaaaggggaggatacaggtcttgagattgtgctccatccgcgtccgcagatcaacgatgatccttcgctcctcctgggtcatttctcctcctcccttcggaaaagccagcctacattcaccggaatatggtcagaattctccggcgacacatccgcgttttccacaataagtacggaggcatccggcccggtggcgtgggtgtgccatgcaccccgtcggacattataaataacaccgggttccagttccaccgcccggacggtgccgggtccttcatctccgccatcaccgatatacagcgtgcagcttcctttcaacagcacaaatacttcatcagaggtattgtgtctctgcatatcctccatgttttccaggtggaactttggggtgtcattcagatatgccacccgccagccctcaaaataaatctgcggatgatagccggcatcctgacagcgtttgatctgcaaaagctcttcattcatgggattcgcctccttgtttcccatatcaccaattggtaaggctcccgtcgctgctgcggcatacggggatgtaggcacggcggaaaggatacttttccgctgccgcctcatcaatatcgcagccgatgccggggcgatcctccaggtagagatagccgtcacgatagaccggtccgccgctcaccacctgttttaccagcgtgtcaacggaaccgtcttcctgtatgccgaaattgtactcggatacgttcagatgccagtttacggcgtgagtaatgggagagacgtcgttgggcccgtgccacgcagtcttaacgtcgtaggtctctgccagtacggcaatcttccgtgcctccgtaatcccgccgatacggatcacatcgcatcggatgtagtctaccagccgccccgtaatggcgggcaagcactcatgccgactcttgtagagctcaccaaaagcgatgggcactgatgtcttttcccgcaccgaccgcaggctggctatacagtccggtgccaccggatcttcaataaagaatggatcatacggctccaactgccggatgattcggattgcctgggcgggactgaatctctcgtgaaggtcatagatgattcccacttcccggcccacctgctcccggactctgataaagaattcaacggtgttgtagatctcttcctccggcgtccaaggctccacttttggcccgtcttgtacaccgcctcccaaagttccgttggcagctggggctccggcccgcagacggatcaccttcaatccccgctctttcacgtaactggctgccagcgccgctttttcctcattggtcttgcccagcacgtgggagtagcacagcaccttgtcccgcacctttccgcccagcagtcggtagagcggttggcctgtcaccttgcccagaatatcccacaaagccatgtccacgccgcacagggcactcatcacgatatttccgccccgccagtaagctccgcgatataccagctgccagaaatcctcgatctgcgtggggtcacgcccaataagtattggcgtcaggaaggaggtaatgaagtcggccactgtatgctcctggccgttcagggaagcatcccccactccataaaccccgctgtccgtaatcagcttcacaaataagtagttttgattgggcgaggtaagaatcactttgacctgctctattttcatcgttaacaccccttgcgcggtttgtgcggacctctgcagtgtgtttgcagttatgtttatctttctaatactagaataacgggttttttgtgaaatgcaacataaaaatagaaattattgcaatatttctcgttttgtcatattaaaaacgaaaatttttcgatttaaggtgaggagagggccggtactgccccgagcgtatactgtttatacgctccgaggagggaccggcccgacagtctcgtttacataccggatcacatcatgcagcagcccgtcaagtgccttcagcacacagagaaggccctcacgggcaagcccatcatagtgaataccgcagaccaccgctgtccggcagccgcagatctgggcaagcacagccgcccactgcttagccacctcccgctcccgatgaccgggaaaatccaccgtctgcgtccggccatcaggctctgccacggaaaccgcgccaatgtggcttttatctcccccggcgaggagcacagaaaggccgtcgtccagcaaagagagctcagcccggatctgccgatctaaaacccggcaggcaaaggtcatgacaggcccctccactcccaaggcagctggcgacccagcggcagcatccggacgatccgggcggcgatctggcggtttacatcttccatggtacgggggtggtcataccacgctggcaccggcggcaccacaaccgcccccagttcactgacggcggtcaggttccgcaggtgcagggtgctcagcggacactcccggggcatcaagaccagaggccggcgctccttcagcgtaacgtcggcagcccggaggagcagagagtccgagtagccgctgacgatgccggccagggtcttcatgctgcagggtaccaccgccatgcccaccgctgaaaagctaccgctggccggggctgcgccccgatcctcctcatcataggcccgggtgcacagcccctctaaatcctggcgggtgacacccgcctcgtgctccagagtagccagaccccatttggaacagatcagatgcacttccaggtccttctcggtctggagttgctgaagcagttctatcgtgaccggtgcgccagaggcgccgctcacacctacaatcagccgtctattcgccatgatcacacctccgggaagagctctggcacccagtgggccgggtccacatccaggaaacgggctcggtggaaccgctccttctgatcaaagggggcggtacagtcaaacacagtcttgcaggcaatgccgtggtcccgaatggaaggagagcaaccgggatcgttggaaggatccagaggatgacagcgcacacccgggatggtaaggatatcggcatccccttgaaaccgggtgttcatggcccacagtacgtcgctcatgtcaaaggggtccacgtcctcgtccaccaagaagatgtgtttgagctcggagaaggcggagaaggccagcaacgccgcctgacgctgccgtccctcgtcagagggcaccgacttcttgaattgcagcacggccataaatttgccgccgccagcactggcgcagtagacattctgcagccgcccaggcatggctttgtccaccatatccaggatactggcttcggtggggatacctgccatggacacatgctcctcgctggggccaatacaggtttgcatgatgggatcctgccggtgggtcaccgccttcaccttgatgagccagcactggtcgctggccgggccggtgtagccgggaaattcaggcatggcgtagccggtgtggctgttctgatcctcctggacccggacgccggggattacctctccctcgataacatactcggcgttcgcaatgcagttctcctttacggtaaggcagggggccagttccaccgcctgcccccggagggcaccggcaatagacagctcgttgaagcccagaggtgtcgtggggggctcgaagcaggaggcaatctcaatggctggatccacgccgatgctgatggaaatgggaagacgctgtcccaactgctccgcccgctcggccatggcgccgatatgccgggcaccgggagtaaaaaagatggacagctcgtcccggccttggaggcacagccggtggatggtcacgtcggaaacgccggtgtctggatggctggcgtaacacatacccagcgtgatgtagggccccgcgtcatccggggtgttggtaggggcaggaaccaacctgcgcagatcaaagtcaggatcctctgcccggtggactacctgctggcaaagcggtgcgcccccagaattgagtaccggctccaccgggtggttgacactgtcccgcagtaacttgcccagctcctccgggcggctatccaacagggccgctactcgcctacggtcggccagcaggccgatggccacccgggcgcccgggtggcccttgatctggttaaacagcatggccgggcccgagcgggtaggccgcatgacagtgccgcctgcccccacatggcggtagaccccggccagctctgccgccgggtccacctgtacgtcggtctctaccagctgtcctggtatggaacgcagacgctccagcgcggagcgcaggtcataaacctgattacattccttcatgacagttcctccttgctgttttcaaatttgatccccatgggtctctcttggaacaggcgggaatccatggtgcgcagttcaggcgcaatcaatggccggaagcccatctgatccagaacatcccgttgcaggtcggcgccgggcgccagttccaccagctggatgcctccgtcggtcaggcgaaacacggcccgttccgtattatagagaacctcctgtccagtctgccgggcgtagtcggcggaaaaggtcacctgctggaccttttccacaaattttacgcctgccccatcctttcggatgctgagtttcccgtcacccacctgaatttccgtctttccggcggtaaatgcacacataaaatacactttgggcgtgctttgggaaatgttaatgaacccgcccgggccagtacagcgccggttgaagctggatacattcacatttccgttacggtcaatctcagccgcgcccagacaggtcatgtttaaaccgccgccgtcgtaaaagtcaaaggtctcgctgagagacataatgctctgaggattgaccgcagcggcaaatcctactcctgccaccggcacgccgccaatggggccggattccagggacagggtggtgtgggcgatgccctcttcgtttgccaccgcgcccacaccggagggaatcccgatccctagattgatcaccataccgtcccgcagctccatggctccccgccgggcaatcaccttgcggatgtccagaggcagcggttcgatggcggcggtggggatgcggatttcaccggacagctccggacggtaacggggcgtagcatagctctgagtgtgaaattctgggctggccttgatgacatagtccaccaaagtgtggtggatgcgcaccttcttggggtggaggctgccccgagccaccacatcttccacctgggcaaacaccttgccgccgctgttgtggacggctagcgccatctccagctccagtccggtgagggcctcgtggtcaaacgaaaggcacccatcctcatcggcataggtggcccggatcaggcaggcgtctaccggaaaagcgggataaaagagctgttgctttccaccgacgtctatccgctccaccacagtgcggccctgagccctggccctgtcattggcccggcaggcgtcctgggtagcgtcggcaaaggtgcccagtcccacatgggtgagcacgccgggttgcttaccggcaatggcccgcagcagatgtgccaccacacccaaagggagcacataggcggccaggcggttctctcccaccatacgtccgattttgggacagttggccaggtgggccgcaataagggtctccatcagaccgtcatcgcacaggcggttgaggcccacattgtcatcggtgttgtttccggtgccgatgccggtaaagacagtgagggcggcgggatgcccgcaggtgcggtggcgctggaccacagcgtccaaaagctgatcgggacagccataggcgccgaaacctccaatagccaccgtggagccatcggcgatcaggccggcggcttcttgtgctgtaatgattttcacgatactgactcctttatttatgccgtggcagaatgccaaaggggcgggacggcggggccgtcccgcccctttgggagcgtgggaagcaaagggtttgaaataccggtgcggttttacaccgcggccttttcctgcccgcgcttaatgcaggtctggatgctgtcatccagcttgtgcagcagaggcgtaataccttttttacaaatcaactgcatgatcacacccagcactgcggacagagcgataacagccagcaggcacaggtagtactgaccggaggtggtcacattctccgcacctaccaggccacagacaatattaatacagtggatgtgaacaatgaaaaagtacagggaaaattcacccagttttccaaaaatgcgtttattgaacaccttgctggtgaggtaatcctgattggccacagcgaaggccatggtcaccgcaaccaccaggtccacatacatctcggaattgacccggccgccgtcggcggtctgggcgatatacagcccgtcgatgccagcaatgcagatgtagatcagccaggcggccagcaccacatggagaacagtcagccacttcttgcctttagtgccaattaccattttccggaggctttcatagggccgatagaggaaaataccaagcgcagtaccccaggtaccgaaagccagcgcattatcaaagatccccaggaacagcacgctgcggtcattcatgctcagtgagccattcaacgcccaaacgcaggggcagacgattacaataatgggcacgatcaggcctcgggtcagatcctcattcttgcacagcagatagtacaggaagtagccacccacaaagatggccgagatgtaccacaggggggaattccactggaaggcccagccggtgtcagacagaatgccggtggagtcgagaccaaaccactgcagcgcggtggtattcaacgcggcaaaaatatccttgaccccattgaactcctcgcccaccatgaacagcttgccgtgccacaggccggtataagctccgatgaagctcataatgaaaccgaacagagtgcccataaacagcgccggccacaggccgatgtagcggctcttcaggtaggtaagcgctagctggctgggcgtcttgccctcgttcagccctttgagttttttgccctcataggatttcattagaaaatagccggtaaataccagaaatacgcccaataccggaccgctggtcagcaacgtactctcaggataaaagactccgccaacaaaccgaaacccgacacttcccatgtgcccccaacacacagccagtgtggcaaaaaaccgccagaaatccacggcgtagttacggggctttttacctgccaaagtttctcccataacacttctctccttttattgttttatgcgaaacggctcatttcgtaattaaattgtatcaaacaccattctctttgtaaatatacgcaaaataagttctacttttttgagcaattggctgtattccttcttgcgttttgcccagaaagcgctataatattattgattatagagaaacgaaaggagcgccaccatggaaaaagaccgctacctgctcagttccctcaacaacgctctgtgtcttctggacctgctgagtcatgccagcagtctctccttggccgaactaactcatttgtcaggaatggacaaagccagtgtatttcgcagtctgtacacattggagaagaacggatatgtccaaaagcttccggaagcgcgttatcggttggggatgaagttcctctactacggaaacttggtggcggcacagcaggatatcgtgacggcagctcgacccgccctgcagaatctgaccctgcggtgcaagctggcggtacacctctcctgcctcaatcaggaacggattgtcactatttgtaaggaggaatctccctatgacattcaggtaacggcacgagtaggcatgaatgctccggcctacgctaccgccatgggtcaggcaattttagcctttctgcctgaaaagcagctagacgttttactgaaccgctacacctataaacgctactcaccacgttctgtcaccgaccagaatcaatgccgggtgatactggccgaggtgcgacgcagcggttatgccacagatatcgacgatcgctttcccggtttcggaagtgtcgcatgtccggtcttcgatccatcaaaccatgtgatcgccgcagttggcgtggtagggctcgcgcaaaccattcaggattgcacgggcaactatgtcgccgaactacgtaaaacagcatcagccattacagaggcaatcagagaatacaactaagccaaaaaccgtaccattcaaaaagcacataatccaccgccatcagttcatgaagatgatacagatggcagaaagtgaggcagggacagtttccctgcctcactttccttgtaacagcctacgattcataaacagcgattgataaatgcggactcggaatttgctatatagaacatcctccctgcaagaccgctccctgccatttggggcaaactacttatcaacgctgccgagactactcaaatacaaaaatctttagtacccaatttttagttgcattcgtcagcaacacttatcttgaaaagggaatatattttaaaatcaactgatctgaccaaacggatctgcttggtttgtgtgaatttacagaccagattattttattaggtgggatgccggttacatctttgataacagtgtgataaattcatttcataaaaaacataaaaagctgttgatatctttgttggtgagtccatgtaaatggttgaagaggcaaatgacgagaatcgttgggggtacactccccaccttgcttgatacagctttgcgtaagtccacttttactagccaacttaatggatcaactccgcgtcatagcaacagataccgagcttttccacgacctttttcccaatggtgtgtccgtcactgccaaactcccggctgatggcaacaatacgattttttcatatcagttcagttccttctgtgttcagttttccatatgttttacagatgataaacactgcaatgaggaaagtcaggacatcggacaccggcatggaatacaaaacgccgtccagtccgaaaaacaccggcagaagcagggcaaaccccacgccgaacaccacttctcggaacatggagagcatggtggcggccagcgccttgcccacagcctgcaaaaagataaagcaagccttgttcacacaggccataatcatcatgcaaaggtaggtccggaaagccttgatggcgaactccgtgtagtagctactctcattggccgcgccgaagatgttgatgagttgctgcgggaatccttccgcaaagagcagcgccacggcgcctactgccgcttccgcaatcagcagcctggtgaacagtgctttgacccgttgggccttccccgcacccatgttgtagcccacgatggggatacagccagcggccataccaacgacgatggagatgacgatctggaagaacttcatcacaatgcccaccacggccatagggatctgggcgtattcttccagcccgaaaacggggtccagggcgccgtacttgcgcagcatattgttgatggcggccatggctgccaccaggctgatttgcgagaggaagctggtaatgcccaggagcagcatccgtttgcagatctttcgagccagtctaaaatcgccgtgcccgggccggatgattcgcatgttgcagaggtaccagatggacagggcagcggttgcgatttgaccaaggaccgtggccaccgccgcgcccatcataccccaccggaagtcgaagataaagagagggtccagaatgatattgatgactgcgcccaggagggtggagatcatggcaaacttgggattcccgtccgcccggatgatggggttcatggcctgcccgaacatatagaagggaatgcccagggtgatgcagaagaaatactcctgggagtagtgaaaggtctcctcattgaccgtgccgccgaacatggcgatgatggtgtcagcaaaaaacagataaacagcggtcagcataaaactgctggccacagcgagaatgaccgcattgccgacgctgtgtttcgctttactcacctcgcttctaccgagactgatgctgacaaaggcgcagcagccgtctcctaccagaacagcaatggacagtgccactacggtcagggggaagacaacggtgttggcggcgttgccgtaagagccgagatagctggcgttggcgataaaaatctgatccacaatgttgtaaagggcgcctaccagcagggaaataatacagggaatggcgtatttccgcatcaggctcccgatcttttcagttcctaaaaactgatttgctgtatccatgtttgatcacctttctttcaaaaaaataaatgcgcaagcccggatccggacttacgcatttctgctacacgattcttgatggaaacgattttacttaaacattatatggcttttctttttagatttcaaatgtcttttggtgaaaaattgttaggtactcaaactatttcaaaattgttttgaccacacaacaagccacagacggggtcggaatagccggaaggtttgcgtttcaaacataccgcaaagcaagttatttggaagaaaaatacctatacactgtcaaaaaagattagaaaaaatcatttttggtgtttgacgtgcgggaggtcacaggttcaagtcctgtatcgtccaccagattagcgggggacatgacccacagaggtcatgtcccccttattgttttgcgtggaaagagccgccccgatgggcggctctttccacgcccgttcacgcgcgccgggcggccatgtccacggccacctccagggcgagggtgatcatctgggtgaaggaggtctggcgctcggtggtggagagggcctcgccggtcagcaggttgtccgaaacggtgcagacggccagagcccgcttgccggcctccgccgcgttgcagtaaagggccgcgctctccatctctacggccagcacgcccagccggccccaggccagagtatcctccgtccggcggtaaaagacatcggagctgagcaggttgcccacggcggtctccacgcccaggcggtgggccgccgacacggcgctctccagcagcgtaaagtccgcgatgggagagaaggtgccgtccagcccgtactgcctggggtagttggagtcggtgcaggcggcctggccgagcaccacatcccgcagcttcagccggggagagatcgagcccacgctgcccacgcggatgatgttgtccacgtcgtaggtgtgaaacagctcgtaagagtagatgcccatggagggcatgcccatgcctgaggccatgacggacacaggcgtgtcccggtaggtaccggtatagccctgtacgccccggacattgttgaccagtttggcgccgtcgagaaaatgctccgcgatgaatttggcccgcagtgggtctccgggcatcagtacggtctttgcaaacgccccctgggcggcctcattgtgtggtgtacccatcgttcttcccccttatttctggtggttctattataagcggcctagcccttctttgcaaggcggaggaggaagctcagttgacattggggcgggatatcattaaaataagagggccatgccggcggcgcggcgcacggctcgaccggatatgacaatcgacctgcagagaggagtcgtcaaatgaagcaaaagaggtggaaaacggacggatatctgaggatattcgcctcttattaccggccccactggaagctgtttgcactggatatggtgtgtgccctgtgcatctgcctggtggacctggccttccccatcgtctcccgcttttccatgcagacgctgctgcccggacagatgttcacggcgtttttcgtggtaatggcggtgctggccggggcttacgtgctcaaggggtgcttttactatatcatcacctactgggggcatctgctgggggtacggatggaggccgacatacggcgggatctgttctcccacatgcaggatctgtccttttccttctatgacaaaaaccgcaccggccagctcatgagccgggtcaccggcgacctgtttgagatcaccgagctggcccaccacggcccggaggatctgttcatctcctccatcaccatcctgggggccttctgcgtcatgctcaccatccggtgggagctggccctgatcgtatttgcggtaatccccctgttcatcctgttcaccaccctgtgccgcaagcggatgatgcgagcctccactgaggtgaaggccaagctggcgggcattaacggggaggttgagtcctccatctccggcatgcgtaccgccaaggccttcgccaacgaggcggcggagagcgccaaattcgaccaggccaacgaccagttccggggggccaagcggggctactaccgggccatggccttctatcagtcgggtatggagttcttcatgggcatcctgtccgtggttgtcatcgccttcggcggattcctgctcatgcgggggcggatggatctcatcgacttgaccaccttcttcctctacatctccaccttcatcacccccatccgcaagctctccgccttcgtggagcagtttatgcagggcatggcgggcttcaagcggtttgtggccctgatgcgggtggagcccgacatccaggacgagccggacgcccaggagctcaccgacgtgaagggggacatccgggtggaggacgtgaccttccggtatgagccctccgatccgccggtgctggagcacgtcaccctccacgtccggcccggcgagactgtggcggtggtgggcccctccggcggcggcaagtccaccctgtgccagctcatcccccggttctacgatgtcaccgagggccgggtgctggtggacggaaaggacgtgcgcaccctcacccagcactccctgcgggccaatatcgggatcgtccagcaggatgtctttctctttgccggcaccatctacgacaacatccgctacggccggcctgacgccaccgaggccgagatcgtggaggccgccaagcgggcggagatctacgacgacatcctggacatgcccgacggcttccagacccaggtgggcgagcggggcgccatgctctccggcggccagaagcagcgggtgtccattgcccgcattttcctgaaagatccgcccgtccttattctggatgaggccacctccgccctggactcggtcactgaggcccgcatccagtccgcctttgacgagctggcaaagggccgcaccaccctcatcatcgcccaccgcctgtccaccatccgctctgccagccgtattctcgtcattgacggcaacggcattcaggaggaggggacccatgaggagcttatggccaagggcggagaatacgcacagttatatcttgcgcagaaatcggtatctgtatagtataacctcccaaaaacgggacggccctggcgggctgtcccgttttttgtgctgccgtacataaatggggcttgcaaaaatcgaacaaatgttgtatacttaaatcgaacgaaagttctatttaacccattgggtctttttttcgacccagcccgtctatacagacagagcgcgggaccgggccggcccggtccggtctatgggacagagcatggagtaaaatcggtttgtcaactggaaaaccgatgcaggagggaacgacatggagaccatctattacagtctggatgccaaacgactcactgtctgcggagaagccgcgggccgcagggccagcggcgggcaggagacggtctgctatgcctttgtcccccggccccgccgcccggtgacgcctgcgggcgggaaggtggtggatttcaccgcctaccggcaggccgcccacccggaggagtatgccccgcgggaggaggcgcccggccggccccggccggtccggcggcggcgcacgctggcgctgaccgtggatctggcggccactggcgcggtggttgtgctgctggcggcggtggtgctgcgctttttcgcgggatagaaccgaaaaattgccccggtgcggctctgcgcaccggggcaattttgtgcagagggaaaaatatgcagaagactattgacaaattgagttagcgggtgtaaactcaatttgttctaggcggttagcattagctaaccgcctgataaaagaaaattggttagcagaagttaacctgtaagggagagaagccacgatgatgcctctgacgctggcaaagcagggcgagacggtgaccattcggaagattaccgggaaggatgagatccgccagcacctggccgagcttggatttgtggtggacggaacggttacggtggtcagcgagctgggcggcaacttgattgtgcaggtcaaggacagccgcattgctctggacaggactatggccaaccgggttatgatctgaggagaggagacagaacatgaagacactgcgggatgcaaaggtaggagacactgtcacggtggtcaagctccacggtgagggggcggtcaagcgccggatcatggacatggggatcaccaagggcgtggcgctgcacgtgcgcaaggtcgcccctctgggcgaccccatggagctgaacgtgcgcggctatgagctgagcgtgcgcaaggccgatgcggagatgatcgaaatcgcctagggggagcgcttccccggatacggccgcgccgccaaaggcggcacagcggagcggtactgcatctgtgaattagttatatcaaactcgcggaaaaggaagggactgagaggttatggagctcaagatcgcgctggcggggaacccgaactgcggcaagacgacgctgtttaacgccctgaccggttcaaaccagtacgtgggcaactggcccggcgtaacagtggagaaaaaggaaggcaagctgaagggccacaaggaggtggtcattcaggacctgcccggcatctactcgctgtctccgtacacgctggaggaagtggtggcgcggagctatctggtgggtgagaagccggacgcgattctgaacatcgtggacggcacgaacatcgagcgcaacctgtacctgacgacgcagctcatcgagctggggattccggtggtggttgcggtcaacatgatcgacctggtgcggaagaacggggacaagatcgacctcggcaggctgggggaggccctggggtgcgaggtggtgagcatgagcgcgctgaagggcgagggcggcatggccgcggcggagaaggccgtggcgctggccaagtcccaccgggcgggtgagctgccccacgtgttcacgggcagcgtggagcacgccatcgcccacatcgaggagtccattgcggggctggtggacgaccgttacctgcggtggtacgccatcaaggtgtttgagcgggacgacaaggtgatggcccagttgaatctgacgggtgagctgaaggcccacctggaggcccacatcgccgactgcgagaaggagctggacgacgacgcggagagcatcatcaccaaccagcggtacgcgtacatcaacggggttgtgaacaaggccgtgaagaagaaggcggcggcccacagcctgaccacctctgacaagattgaccggattgtgaccaaccggattctggccctgccgattttcgcggtggtcatgtttgcggtgtactatgtggccatcggcacggtgggcgactgggtgaccggttggaccaacgacgtgctgttcggcgagattgtgccgccggcggtaagcggctggctggagggcatcggcaccgccccctggctgcaggggctgattgtggacggcatcattgccggcgtgggcgcggtgctgggcttcgtgccccagatgctggtgctgttcctgatgctgtccatcctggaggatgtgggctacatggcccgcgtggcgttcatcatggatcgtatcttccgcaagttcggcctgagcggcaagagctttatccccatgctcatcggctccggctgcggcgtgcccggcgtcatggcctcccgtaccattgagaacgagcgcgaccgccggatgacggtcatgaccacctgcttcgtgccctgcggggccaagatgcccatcatcggcctgttcgccggcgccctgtttggcggcagcggcctggtggcggtgtccgcctacttcatcggcgtggcggccatcatcttttccggcatcatcctgaaaaagaccaaggcgtttgcaggcgaccccgcccccttcgttatggagctgcccgcctaccacgtgccctctgtgggcaacgtcctgcgggccacttgggagcgcggctggtccttcatcaagcgggccggcaccatcatcctggcctcctccatcatcctctggttcctccagggcttcggctttaccgaggcgggcttcggcatggtggaggacaacaacacctccctgctggcggccattggcggcgcggtgtgcttcattttccggcccctgggcttcggcacctggcaggccaccgtggccaccgttaccggcctcatcgccaaggagaacgtggtgtccaccttcggcgtgctcttcggtctgggcgccgatctgacggaggaggaccccggcctgctggccgccgtgggcacccacttcaccgccctgagcgcttacagctttatgatcttcaacctgctgtgcgccccctgctttgcggctatgggcgccatcaagcgggaaatgaacaacgccaggtggaccctgggcgccatcggctatatgtgcggctttgcctatgtggtctccctcatcgtctaccagctcggcgggcttatcaccggcgaggtctccttcggcatcggcaccatcgccgccgccgccgccctcgttggcttggtctacctccttgtccgcagaaacaagtacgacgagaacaccctttccatttccgccgtcgccgccgcggccaagtaaggagcgcctatgaatgcaccaacaattatcattggcctgatcattttggccgtgtttgtggccattgtgggaaagggcatttacaaccgccgccatggcaagagctcctgctcctgcgggggctcctgcggcggagggtgcggccactgcgcctcgtccgggctgtgccaccctgagaagcaaccgccgacacgccggggcgcggctggcgccccttagttaaggagtcatacatggagctgaccaataccaacgtacgctatcttttgaccatctaccacctctcgcaggcccggctggaggtgtcctccaaggatatcgcccagaccctggacgtgtcccgcgcctccgtcaccagcatgatgtccattctgacagacaagcgcctggtgaccaaggagcggtacggcaaggtacacctgaccgacgacggctgccggtgggcccgggtgctggccagccagacggacaaactggccgagacgctgcaaaaccggatggagctgtcctatgaggaggcgtggaaggccgcctgcgcggcagtctccgagctgccccgccactgttttgagcccatccatgttccagacagacagagaaaggaagttttccaatcatgaagtggtatcagaatccgaaggtcctctgctttgccggcggcgtggccgccgccctggtgggagccaaggttgccaagtcccccaagacccgtgagctctgcgtggccggcatggccaagggcatgaagctccagcaggacgccagggtgaccctccagaacatgaaggaggacgctcaggatctgtgtgcggaggccaagcagaaggcggcccaggagaccgccgaagaggcgtaacgcagccatgagatatcgcatcgcatacgacgagcccggccgccttcgggtgcgcttcggcccggatgcgtttacccaggagcagggctacggcattgccgccctgctcctgggccgtccgggcgtgcgggaggccgtcacctgtgcgctcaatggcagcgtgctggtgtgctacgagggggagggccgggcggaggccctggcagtactccgggggctccggcgggacgccctgccggtggggaccgccgccgacgatgaccagctccgccaggtggacagccagtttctgggccggctcctttccatggccgcccgccatttcctgaaaaagtggtttcttcccttccctgtccgctgcgccgtgactctgtggaacgcggcgggctactggcgggagggcctgagaagcctgggcggggggcggctggacgtggccgtgctggatgcggcctccatcgccggagccatcgcccggcgggagtggtccaccgccggctcggtcatgttcctgctgggcctgtccgccctactggaggactacacccgcaagcgcacccagaccaccctgacccagagcttggccatccacgtggacaccgtgtggcgggtggcggaggacggctccgaggaatccatccccatgggccgcctggctctgggggagcgtatccgggtgcgctccggcgccctgatcccggtggacggcactgtcacagacggcgacgccatggtgaatgaggcgtccatgaccggcgagcccctccccgtccacaagcgccagggctccaccgtctacgccggcaccgtgctggaggagggcagtctggtcatccaggccgcggccctggccggcgagagccggattcagcagatcgtgggcctcattgagaattccgaggcgctgaaggccggagcccagagccgggccgagcggctggccgacgccatcgtgcccttcagctttgccggggccctggcggtgggcctgctgacccggaatgtgacccgggccctgtccgtactgatggtggactactcctgcgccatcaagctgtccacccccatctccatcatctccgccatgcgggaggcctccgcccgccgtattatggtcaagggcggcaaatacctggaggcctttgccgaggcggataccatcgtattcgacaaaaccggcaccctcaccgccgcctgcccccgggtggaggaggttctggacttcaccggccggggggaggacgagctgctgcggtgcgcggcctgcatcgaggagcacttcccccacagcatggcccgggccgtcacccgcgccgccgaggagcggggcctcaaccacgaggagcgccacgccgaggtggagtatgtggtggcccacggcgtggccaccaccctggagggggagcgggccctcatcggcagccgccacttcatcttcgaggacgagggcgttgcctgtaccgacgaacaggccgggcggatcgccgcggccgcccgcggccgttcggtgctctatctggccatcggcggcaggctggccggcgtgctgttgatcagcgatccgccccgccccgaggccgctgaggccatcgccgccctgcgggcgctgggggtgcgccgggtgatcatgctcaccggcgaccaggagaccgccgcccgggcggtgtgtaagcggctgggcatcgacacgttccgcgcccaggtgctcccagccgacaaggcctccctgatcgagggctacaaggagggcggcagcaggctcatcatggtgggcgacggggtcaacgactcccccgccctggccgccgcggatgtatccgtggccatgagggatgcctccgacctggcccgggaggtggcggatattaccctcctctcctccgatctgcgggagctggccgccctgcgccgcctctcccagcggatgctggagcgcattaaccgcaactacaggtcgattttgaccatcaacaccagcctgctggcgctggggattttcggcatactgccgccgaccaccacggccctgctgcacaatgcctctaccatggccatcagcgccgccagcatgcggccctatctgcccgcgcccggcgggcgcggggcccagggaaaggagcctggcaatgaaacagcatagattctgggcttggggcgccgtgttctgtatgctcatgtgcatctacaccggcaagcgccgcaagtaaagcaaggcagagaaggcccctccccgccgtccggcggagaggggcctttgccgccgccgtgacaggagcgcgcgggcatgcagtcaccacgccggacggcgggactgtccggcagtgagctggcggagggattgggcgcacagcgcgccgtagaacttgagatacttcttttttgcctggcgctggaggcgctggcgctcctgaaaggccttccagcaggcgcagctcttgtggcagccgctgtggtaggagggacattggctctgacagggaagcatgggggttctcctttctgcggggcgggaggtacggttcctgtccagtgtaggccggatcagagcccaactgccaccatggcgctgtaaaagggaggtaaataattggagtttaccgcatttgtagagcatgctcactaaaaatagtgacaaataggggaataaatatatacaatctaaacaaaatggagtggctgaaatcgggcaaaaggcagaataatgtgagcatggttgcaattggaagatgctcatggtatcatgcaaaacaccttgcggggtcggggctctgaccactggagactccgcgccggaggactcctggtcgcaaggaaagaaaaagaggaggaaacatgaaatgaaatcccataagccatccaaactgatcgctctggggctcgccctcaccatgggcctgagcattcccgcggcgctggcagccagttctctggtgcccgcctccaccaaggtcacggtggacggtaaggcggccgctgtcgagggatacaatattgacaacggcaacaactattacaagctacgcgatttcgccagcgcactggacgtgggcctgacctgggataaggccaccgacactgcggccatcgacaccggctcccactacaagcccgacgccacccagctcatcaccggcaactgggcccccgctacccgcgcccgcatccaggccgtgattgacgagaacgccaaccagggcaagtacgtggtctttgactttgacaacacctccgtgatcttcgacattcaggaggccctgctcatctaccagattgagaacctgcaattcaagatcgaccccgccgacatggaggccgttctggagaccggcattcccgacctgaacaagtccatgggcaccagcctggacggcaagaacatcacccccgccaccctggtggccgacatcaccagcgattacgagtggatctatgccaactacgagggctttgagggggacaaggacctcaactacatccacgcgtccaaccagtaccaggacttcgccgccaagctgcgcttcatgtacggcaacctgggcgactactttgatcacgccgtctcttacccctgggttggctatctgttcaccggcatgacccccgacgaggtgcaggagctggctgccgcctcccaccagtattgggcagactacggccgctatgccgaggaaacctggacctctcccgtggagctgcccggcaagaccggcattgtctcgattgactttatcaccggcctgaccttcaccgacgagctgaaggacctgtatgccaccctccaggccaacggcatcgaagtgtatatcgtctccgcctcccccatcgacaccgtgctggccgccaatgagaccatgggctacaacctgcccgaggaccacgtctacgccatgcgcaacaagctgggcgaggacggccgctacatcaacgagtataactacgactggggcggcgagggcaagtacgcccagacccagggtgagggcaagagcaccattatcaccaacttcatcgcgccccagtatgacaacgccggccccctgatggtcttcggcgacagctccggcgactggaacatgatgaccgactggatggagagcggcgacaccgagctgggcgtcatcttcaaccgttaccgcaagcccggcagcgaccccatctggcagggctccaacgaggccgcccagtccatcggcgatcctgacgcccgctttgtcctccagggccgcgacgagaacaccggcgaactgcgccccagcgagaagtccatcctgctgggtgagaccgacgaggtgctggtccgccccgccgagtaaggcagacataagcgcaatttcatatacggcggcagccgggagtggagcctgcgggctccctcccggctgttctgatcaaactttaagatttttttaatgaaaaccgggaaccttgctctggacatttcgtctgtaatgttggataatggaatatataaccaagaaaaaacctgcattggaaggagagaatgaacatgaagcgaacccatagagggcttgcccggctgctgtccgcgggtatgagtctggcccttttaacgagcctggtacccggggccatggcggcgagccgaaatgtagaatacgaggtggatgcggatgaggttctctacttggaaaaggaggacttcgataaatttgtgtatgacgaaacgtcacagggtaccgaggtggatgagctctggtttacaagcttaccctcgtccagtaagggtgtgctatattttgactatgacggccgagacgaatatgaggtcgaaaagcgagagagctttacccgcagagacctagatgatctcgcctttgtgccagatgaggactacgatggttccgtaacgatcggttttagcggtgagtccgaccagggtgagaatttttctggtacactttatattgaggtcaatggcacagggcgttcatcctctgacggcgaagtgacctatgaggtggatgtcaacgacgccgtggatctggacgtggacgattttgacgactatgcctacgacgagtcggacggcaccgaggtcgattacatcttcttcaccgacctgccctcctccagcaagggcaccctctactacgactatggctactccagtgaacgcgaagtagagaaggacgaggagttcgactgggacgagatcgacgacctgacctttgtgcccaagcggaattatgaggggacggttaccctgtccttcgagggccgatcggacgcccgggataagttctacggcgacctggtcatcgaggtgggcggcggccggagcagcagcgccgccaggggcgacgtgacgtacgatgtggacgtcaacgacacggtggacttcgactatgacgacttcgacgagttcgtctacgacgagaccagcggtaccgaggtgggacgggtctggttcaccgatctgccctcctcccgggagggcaccctctaccgggactatgacaagcgggatcaggaggagattgacgaggacgaggaaatccgccacgacgagatcgacgacctgaccttcgtacccaagcgcaattttgaaggggcggtcaccatcccctttgagggcagggcggacgacggcgacaagttcgccggcgagctggtcattcgggtgggcgatgccggcggcgccgacattaccgtggagctccaggccggcaacggttccaccgtcaacttccagacggacgcgttcaacgaggcctgcgtgaaggagaccggcgccaatctgaactatgtgatctttgattacgactccggccgcggcggctatctgtactaccagcacggcgagtccggcgagtctgaggtgggctccggccgttattaccgcgcctcctctccccggctggaccaggtttcctttgtccccggcagcggcactggcagctccgtgcgcatcccctttgagggggaggccaccaacggcaagtccttctacggcggggtcaagctgacctatgtgacgctgagtgagcccaccatcatcacctacacctccaccggcctggccgtggacttcaacgccgccgactttaccgccgcctgcgcggcccggggcggcaaggccctgacctccgtccggttccccgcccccgacaccaccggcgggcagctctactacaacttccacactcccacccagtaccgcggcgaggtggtttccaccgtggactactccgtgggcggcgtctacctgctgggcgaggtcaccttcctgcccaaggcgggttacagcggcgttgtaaccatcccctatgtgggtaccgatgccgacggcatcgagtataccggcaccgttcaggtgatggtcacgccctccgcctcctcccgcttcagcgacatgggcagctataacagttgggcgggagcttccgtggaattcctggccgcctacggcattaccaccggtacgggcgacggcgccaccttcagccccgcctccaccctcacccgcggcgactatatcctgatgctctaccgcacctttggcttcagcagcaccgccgccgcaggcaactttactgacgtggccgccggcagctactacgccgaggccctggcccatgccaaggctttgggcatcgccaccgccgaggcggacgggagcttccgccccaacgaccccgtcacccggcaggacgccatggtgttcctcctgcgggccatgcaggccgtcaaccggtctgtgcccaacgcctatgacagctacctgagccgcttcccggatggggcctccgtggcggactacgcccgcacggccatggccgccatggcccaggccggcgtgatccagggcaacgagcagggcaagctcaaccccaccggaaccctgaaccgggcggagatggccgtcattctccaccgcgccctcaccctgtaacccagctcccaagccggggccgcccagcggccccggctttttgtgcaaaatatgggacagggaggcttgaaaagggcggcttgggtatgatatagtatcaaggtattggtatcggctgcatcccttcggatgtggtcgtttttgtgagacggaaccgggggtatggacgtgtttgacggacttctgtttgatctggacgggaccttgtgggattcggtggatgccatctgcatctcctggaaccgggccctggagcggcttgcgccggagtatgccggcaccgtgacccgggcgcggctgctgccgtgtatggggatgctgctgcccgatatcctccaccgcctggtgccggagctggaccaggagcggatgaagcccattctggaggaggtgctgtcggaggaaaacgcctatgtggccgcccacgggggcgtcctctaccccgaggtggagcagaccctggcggcgctctccgcccgctgtcccctctttctcgtcagcaactgccaggacgggtatattgaggcctttttccaggcccatggactggggcgctattttacggactacgaaaaccccggccgcacggggctgcccaaggcggacaacatcgccctggtggcggagcggaacggcctgaggcggcccctctacatcggggacacccagggggactatgacgctgcctccaaggcgggcgtccccttcctccatgccgcctacggcttcgggcgcattgaccgccctgtgccctcggtggctacctttggggatcttcctgatgcgatccgccgcctcactccgccgtaaggcggggcgatgtaggcatcgccccctacaacgtccaaatgcgggcttgttcccgccgtaggggcggatgcccacatccgcccggcacccatgcaccaactctatcaaggaggacattaccttgtcacaatacgagaaagaaatcaatcgccggcgtacctttgccatcatcagccacccggacgccggcaagaccaccctgaccgagaaattcctgctctacggcggggccattgcccaggccgggcaggtcaagggcaaaaagaacacccgggccgccacctccgactggatggagattgagaagcagcgcggcatctcggtcacctcctccgtcatgcagttccagtacgagggctactgcatcaacatcctggacacccccggccaccaggacttctcggaggacacctaccgcaccctcatggccgccgacagcgcggtgatggtcattgacgcggccaagggcgtggaggcccagacccgcaagctgttcaaggtgtgcgccatgcgggacatccccatctttaccttcatcaacaagatggaccgggaggcccgggactccttcgagctgctggaggagctggagaaggagctgggcatcgagacctacccggtgaactggcccatcggctgcggcaaggacttccagggcgtatatgaccggggcagccgcaagattatccacttcacctccaacggcggggccaaggcggccaccgccaccgaggtggagctgggtgaccccaacctggacggcctgatcagcgagcggctccaccggcagctcaccgacgagattgagctgctggatggcgcggccgccgagtttgatctggaccgggtgcgccacggcaagctctccccggtgttcttcggctccgccctcaccaacttcggcgtggagcccttcctggagcacttcctccagatgaccaccgcccccctgccccggcgggcgggcgagctggtggtggactccctggacgacgacttctccgcctttgtgttcaagatccaggccaacatgaacaaggcccaccgggaccgcatcgcctttatgcgcatcgtctccggccgctttgacgcggataaggaggtgtaccacgtccagggcggcaagaagctccgcctgtcccggccccagcagctcatggcggccgagcgggagatcatcgaggaggcctacgccggcgacatcatcggcgtgtttgacccgggcatcttctccatcggcgacaccctgtgcgccccgggcaaaaaattccgcttcgaccccatccccaccttcgcacccgagcacttcaagcgggtgcgctccctggataccatgaagcgcaagcagtttttgaagggaatggagcagatcgcccaggagggtgctattcagatctttaagaccccctacaccggcatggaggaggtcatcgtgggcgtggtgggcaccctccagttcgacgtgctggagtaccgcctcaagaacgagtacaacgtggagctctacatggagggcctgccctacgaatacctgcggtggatcgagaccgacgacggcgagcccgtcaaggaggaggatctcatcctgggcaccgacgtgaagctggtggaggactacaagggcaaccagctcctgctgttcggttcccagtgggccatcggctggacggaggagcggaacaagaacctcaccttccacgagttcggcggcaccaaattctaataaaatgaaaaaccgccccccggcctgcgccggggggcggtttttgacacgccagttactgcacgggggtgtagctgaggggggattcctcgtccgtggcctccagcttgaagataacgggccgcaggccgtcgttgcagctgcaaatggccacgccgggcttgcgaatccagtctccgtagtagaacagcccctcccccgcgccgtgggccagggcgaaggcgtactggtagaccgccttccacgcctcgtcacagaagccctccggcttggcgtagtcggcgtaaaagacctgcccttcccgcagcatgggacaggccgtcagcccctcggcgccgtattcctctgccagctcccggtccagggtggttttcagaacggtaattttcacgcgcttcataacaatccctcctcgtgtgagaataggatagcaccgctcaagggcattgggcaaggggaagttttccacacgggggaccaaacgggtggaaaagtcagccctggctgtggggagcgagcctggctttaccgcctgcccggtccagggccagcgccaagacagtaaagaccgccccgctgcccaccgcctgtaccagcgtgcccaggaactggggccagaaggcgttgacgccgcccagcagcaggcaggcggccaggccgtacgccgccggggagagcaggcaggccagcagaagggccgccccgttccgggggcagaggagccgcggtccccggctggtaaacaggagggccaccagggccttgatgagcagcgtggggaccacccacaggggcgcggtgagcagatccgccagcccggcccccaccatggcggcgcccacggcgtagggggcgggcagcagacaggccgccaggtagatcagcgcgtctcccaggtggatgtagccgccggtggggatggggatatggagcagataggcggtggtgaccgcaatggctccggcgaacagggcggccaggcagagcagccggagttttttcgattcgcgcacaggggctccctccttgtttcatctgtccccattgtacgctccaactgaccttgttaaaagtatcagaataaatctattttaaaaggtcaggcgaggcggaggaaacacacaaaaactgccccatccccataaaatagggcagggaggtggaaaaatggaagagacagtcctgcgggagcagctcaggacggtggatgaatccctgctgtttctgctgttgatcgtactgtcggtgctgctctcctactggggggtgcgcatacagcgggaggggctgtgcagaaccctccagggggatgccgagggggcggccgccctgccccgggtgtttcccatccgcctgagcgcctcggccctggtggtgggagcgctgggctttttcctctgtctggccctcaagacggagcgggagaccgcccggggcgggacgccggcggcccggcggtcggcgtgcaccaacctgtgggcctccctgtttgtctttctcgccgccctgctgcggctggacgacctgctgggcacccgggatgcctcgggggaggtcatctgaaataaagcaggcgcgccctgcggcgcgcctgttgaggatgcgggtcagtttgccggccccttggcaaaaaaggtataaaccccggtggccaccgtccggcccgtgtcgtcggtgagcacggcctcgtacaccaggacggttttgcccagcttcctgggcgtggccgtgcaggtgatgcgcgctccggacgccggggccagatactgcatggagcagtccagggtgacgcacatgtgcccggtggtgaaggccgccgtgccgcacacggtgtccgccagggtgaccagcgccccgccgtggacgatgcccatggggttgaggctggagggctgcacatccagcacgcccacggcgctgtgatccggccgcagctcggtgacgtacatgtggttggcgggggcgaagcagccgctggtattcaccagctccagaagcttactgtaggaatccatcgagaatcttctcctccgcctcctgctcggtgaggcccagggtcatgagcttgagaatctggtcgcctgcgatgcgtccgatggccgcctcgtgaatgagctgggcgtccacatggttggccacgatggcggggatggaggaaattctggcgtcgcccatgatgatggagtcgcactgcacatggccgaagcacctggcgttgcccgtcaccttggggtagaacacctgctgggactggtcctgggccaccgagcgggacaccacccggccgttggccccctcgccgtccagaatgatctccatatcgctctcggcggtctgctccccgtgggtgagcagcttctcggtgatgatggcctcggcgtccttccccaccacgattttcgtctcccgcttggtggagtccacgccgcggatctgggtgctctccagattgatggtggccccctcctccagatacacgacggtctgggggttcatgatgcgcttgccggtgccggggccctcgccgtagtggcgctccacatagcggaccttggagtttttgcccacgtagaaggtgtgcacgccgtcgtgctggctggtctcgcagccggtgttgtggatgccgcagccggccacgatgtccacatcgcagtcctcgccgatgaagaagtcgttgtataccatctcgctcagcccggtctggctgatgatgaccgggatgtggaccgactcgtgcctggtgcccggcttgatgcggatgtcgatgcccgacttgcccggctcggtcttggtggtgatctcaatgttggcggtgctgttccgggagtccagcgcgccgttgcggcggatgttgtaggccccctggggggtcttctccagctccgcgatctctttcagcagtttccattcagcctgatccatgcttacctcgccccctccgacatatagctgcacccggccgaggtgttggccaggatctgggggaaaatctcgtccttgggcccgtgcttggcgattttcccgtcgcggatcatcacaatctcgtcggccaggtcaatgatgcgctcctggtgggagatgacgatcagcgtggcctcccgcttctggtggatggccctgaaggtctcggtcagcttggcgaaggaccacaggtcgatgcccgcctccggctcatcaaagatcatcagccccgacttgcgggcgagaatcgtggcgatctcaatgcgcttgacctcgccgccggacagggaggcgtccacctcccggtcgatatagtcggcggcgcacaggcccacccgggtcagatactggcagccctcctcccgggtcagcttctcgctgcccgcggccagggccagcagatcccgcacccgcaggcccttgaagcggggcggctgctgaaagccgtagctcacccccaggcgggcccgctgggtgatgtccaggccggtgatgtcggtgccattccaggcgatggtgcccccggtgggccgcaccaggcccatgatggccttcgccagggtggtcttgccgcccccgttggggccggtgatgaccacaaactgatggtcagctacggtgagggagacgtcgttgaggatacccagctcctcgccggactccccctccacctggtagctgagatgctttatctccagcatacgcggtctctcctttgtactatgcttcttctcatgagatgttattttatcacggcgggggggaaaatacaaccctgccgggcgcaaaaaccacactattcgcataggataaggtgaatccaaatcatcaggaggctttgtctatggaacaagatcatttgccctgctcctgcgaccaggaggtctttgagcgggtgtggcggcgggtgatgcccgaggaccggcccgactgcccctttaccctgggcgaggacgctgccgcccctccggccatccagccccccgcggtggctctgcctgccgtggtacatactgctccagccggcgaacaggcaccctcccggcccgtggtgggagaagagcacgacgtgccctgcctgggggcgtcctcggcggtgtacggcgcccagctccagcggctcattgaccgggaactggcggattggagggcctatcaggccctatcccgccgggcccagggaaacagcgggcgggtgctggccaccatcgccgccgacgaacgccgccacgccaagcggctttccaccgcctattttctcatctccggggtgcggtactggccggtagaccgggtacccaatccatcccccgccccattctccgccgccctgcgggagcacttcatggaggagcagcggggggcggccgcctaccagaccgcggcggcggagaccgccgatccctgcctccacgagctctttctggagctggcgggggaggaggactcccacgcctggctcctgcgcagcgtactggagcagctataagaacacccccggcgcacggctttgacgtgcgccgggggcctgcttttagtatccgttgaccacagcgtccagcaccctggccgccacggagcccgccgcgtccgcaccggagccgccgttctccaccagcaccacaaaggcgtagggggcgtcggggttgcggaggaagccggcgaaccaggcgtggggggccttgccgccccccacctcggcggtgccgctcttggcgcacacgtccatgttggggaagcgggaggcgccgtactgggccgtgacattgtgggccatcagctccgctagggcggcggcggtatccccctccaccagctttttggtgtgccggggcagggcgggcagggacggcaggcccagggcgttctccgtcttgagcaccagccggggcatggccgccgttccgccgtttgcgatggcccccatatagaccatgagggcgcaggggttggccaggtcgttgtactgccccacgccggcccagcccagctcgttggccgtgaggccgtcaaagtcgaaggagccggcggcggtgttcaggccgctgacccggtaggaggaggtgagccccgcccggacggtgtactcctccagcacgtcctcccccagctcgccggccagcagggcgaacaccccgttgcacgagttggccagggcggaggagatgtcctgctccccgtgggcgtgggggcaggtgatggccccgtcccccacctgggtggagccggtgcaggtccaggtgcggtcaaagagatcgggcatgcgctcaatggcggcggagagcaccacggtcttgtagaccgagcccggcgggaaggtgccggagaggaagcggttgaggtacgccccctcgtaggcgtcgttctcctccagctcctcggcggagggagggttcagcgggtcgaaggcgggggcggacaccatgcacagcacctcccccgtctcgtagttgtagacgcccaccgcccccttgcggccggccagggcctcataggcgatgtagttgtaccgggcgtccagggtgaggtagaggtcgttgcccgcccccaggggggagtaggccccggtgagcaggttgtagccggagagctggtcggcaaaggccaccagcgccccggtgccgatgttgccctgggcgtcccccacggcgtggagggtggccttgcgcacggtggagttgtcgtaccagcgccgggcgccgtcctcctccgtccaggagagcacgtccccgtcccggtccagcacctggcccaccgagagctgtccctggcggttgtagaggtggcggttggcggcaaaggaaacccagcggccgccatttttcacgaagcggaacacaaacaggccggagcccagcagcagggcggcggccagcaggaggcagagcagggcccgcttttcaatcttcttcatcgtccgcctcccattcgtcggtggatttgggggccagcgccgccccccggcggtcctcccgccgggagggcaggcggatggcaaagctggcgttctgccgggtgtcggtggccttgaggaaggccagtagcccccaggaggcgatcatggccgtgccgccgttggacacgaagggaaaggtgacgccggtgagggggagaatgtccaccgcgccgaacacgttgaggcaggtctgaaacaccatcatggaggtggcggcgcaggcggcgatgacgtaaaaggagctccgcccggcccggcaggcccggacggcgaacaccgccagagtgagaatggacagcaccgccagcagggcgatgatcagcccccactcctcgcacagcatgccgaataccaggtcggtgtcccccgcgcctacggtgtggagccagccctcgccggggcccacccccaccaggccgccggaggcggcggccgacatggtgcgggtctgctggtagccgctgcctaccgaggcgttctgccacgcgtggccccaggtggtgaagcgctgaaggatgtagggcttgagggagagcatggtgagcaccgcaaacaccccgccgccgcagatgagggccagggtggcccagtcgccggagcggaggtaggcgataaccaggaaggtgacaaagaagatggcggcggtgccgaagtcgctcatataggccagacaggccaggcacacgccggtgagcagaatgaacaggcccaggttccgcttgcggaagagccggtccagggtggccgccccggcaaagatgtagcagattttggccagctccgagggctgcaccgagatgccggcaatggtcagccagttggccgctccatatttggtgccggtgaggcccagcaggtagagcaccacggtgaggctcagcaggccgatggccccggcggccatgagccagcggattttcttggcccgatccaggttgcgcaggaagacccccagcaccaggaacagggccagtcccagcaccacgcagaggaactgcttgaacagggcgggggtattggaggaggaggtcaccgccagggagagggtggacaggaagaaggcgatggtctccatctcaaagcctacccggcgcagggcgcggagggtgaggaagtacagccacatcacccccgtcagcagcaggaaggtgagcgggatcatcaccgtggcgttctccccctcgctgatggtgagctggagtgcggtgagggcctggaacacggtgaggagcaccagccccagccagggggacacgggccgccaggcccgccgccgctggcggcgctgggccttttcctccggagagagggggagcagcacggtctccaccccgccgatgcccaccacgtcgccgtactggacgggggcggagccctccaccggcctgccgtttaccgtcacgccacccttggagcccaggtcgtaggccgtccaggtgtcgtccgcctggcgaatcagggcggcgtgctgccgggataccacaggatagttgagaatcacgtcggagttgccgccccggccgagaatgttctcccagtgggtcagcggctcctgagccccgttgggcagggtcaggtaggcccacacctccggcagacagggcacggtgagcagggagcggatcgtccgtatgagaatcagcagggccagcaccgggaacaaaaagcgcaccgccgtggtgaaccaggcccagacctggggattggcggccatccagtccagcagcgcctccatccgcccacctccttttcgttggaatatacagcagtatagcacaaatggggccgataaaaaagcggaaggccgtccgccttccgcattcttcaagaattctttacaatttgccctctccggcggtataatgggctcaccaatgagagaggatgtgagcccgtgtctacgattatcgacgccaagggcaagccctgccccaccccggtcatcctggccaagcaggccatggccgccggggaacattccttcaccgtgctggtggacaacgccacggcggtggaaaacctcaagcgcctggcgggcaaccaggggttcggagccgccgtcacccagggggagggggtgttttccgtggccttcacccgtaccggctgcgccgcctgtgaggaggcggtgagcgctcccctgcccgcccccggcggcgactgggccgtgtttgtgggccgggatatcatcggggacggcgaccgggagctgggcgccaacctgatgcgcatgttcttctacactctggcccagggggaggacaagcccggcgcggtgctcttcatgaacgccggcgtgcgcctgcccaccctggacgagcagattcccgcccacctgaaggccctggccgatgcgggcgtcgagatcctggtgtgcggcacctgcctcagcttctacggcctcaccgaccagctccaggtgggcacggtgagcaacatgtacgacatcgtcacccgcatgcagcgggcggccaaggtggtctccctgtaatggactacggcgtgatcaccttcacctccacctacggggccatctacgcccagaaggtgctgcgaccggtggcggatgtgctcaccatgccggtgctgcgggagatctccctgggctgcggcatcgccgtgcgcttccggccggaggacggggcggcggtgcgcgccgccctggccgcctccaccctgcggccggacgagtacgccttttacggtgttaccggctccggggcggccctgcgggccgagccgctggacgggtaggggccgcccggcgctcagaagatccagccgatgagcagggacagggcaaaggccacgacggcgggcatgaagttttcccagcgggtgggcttgtcgagcagggccttgatgagcagcaccacgcccgcgacgcgcagcaaccagggcagcaggcccatgagcagcaggaagggcaggcccaccagaaacaggatgacgggaatgagaatcacagcggccagacagatgatgcccagtgtgaacagcgtaaccatggaatcagtcctccttttgatggtaccagcttaccacacccagataaaagcgtcctaaaggcattcttaaaatcagataaaaaatccccggcgtcagggggcggggctgtgccatccgcccctgacgccggggcctttttctgcgttccggttcggccaaacggttttcataaaagtctcgcttcgaggctgctttcccggcagaacgtaatggatatcagatggatgcatagaataaatgccttggggcacgaagaaatgggcaggactgtcatgtgaaaaggataatagtccttttcttgtatgcaatttggtagataatatgatagtatgtgtgctgtggcagcattcgattaccgtgatatgctctgtggcatggaacactcctgttatactgctcctgtcggtacagcatttcttgctgccattccgtttggttttggaatgattagcggtttcatcacagactcagagcaagggagggcttgcgaatggcagatacagattacatctttcacatcagcccgtatgataccgaaaagcttttgccgcaagtgagcagggcgctcgaaaaaaggacggaaatggtttcgcgggaacgatttcccgggctatggaagcataccgaccgattccgctctatggcgcgggggcggaaaaggagcaggctacgcacaaggggaatgagtgcgttatgtctggcggccggcatttttctggctgttcccggtctgatggagccgcgagagctgttcgtgccgctgcttgtcggcgcggctgccatgggtgcgggtatcattggcctgtggcagagccgcgcgcgcaagaagaatccgtttgatagagcggcaaagatattgttggagggcaaagacaagagttccgcggagcaagccgcttcggtgtccttctcagaggaggggatgaccgttccggcgggcggcggcaaggcggaatttgtgccatatcgagagtttgaatgcgccgtcgaaacggcggatagttttcttttcgtctttggcggccgtgtcctgctgttgcagaaaatggacttaaaagcggaatgtatcggcgatttttgcagtctgatctcggaaaaagtgaaaccgtatcactcgattgcgtaaaagggcggccgcagggaaagcccatgaggctgccgtcagagcggaaaaacgcgcccgcctcattcaaaatgaggtaggcgcgttttcatgcgcagcgcgcttgacaccgcgccggggatttttgcatcaacggaagtaggccgcgccgctctcgaagaggggctggtgcttgtcgcccgggatgttgacgcctacataggggccccggcgctccgagtggcccatcttgccgaacacccggccgtcgggggagaagatgccctcgatggcctccagggagccgttggggttggcgtcgatgtccatggaggccgcgccggaggcgtccacgtactgggtggcgatctggccgttcgcgatcagccgctccagctccgcctggggggctgtgaagcggccctcgccgtgggagatggggatggcgtggaggtcgcccacatgggactggagcatccagggggactggacagaggccacccgggtggtgacgtaccggctctggtggcggccgatggtgttgaaggtcagggtagggcagccctcgtccatggcccggatctcgccgtagggcaccaggcccagcttgatgagggcctggaagccgttgcagatgcccagcatcaggccgtcccggcgcttgagcaggtcgtgaaccgcgtcggtgagccggccgttgcgcaggaaggagcagatgaacttggccgagccgtcgggctcgtcgccgccggagaagccgccgggcaggaacaggatctgggccgcgcggatggccttctccagggccagggccgactcctccagggcggaggcggtcaggttgcgcaccaccacgatctccggctccagccccgcccgcaggcaggcccgggcggagtcgtactcgcagttggtgccggggaacacggggatggccaccctggggcgggcggttttggacttgcacaccgccggggaacgcctgtcccaggagagggtgcgcgccggggcggactcccccgcccgggtggggtacacgtcctccagcaccctctcgttgagggcgagcagctcgtcaatgggggcggagtcgccgccgatggtgatcaccggctcggcggtggtgacgcccagcctgctcgccagggggaagtcgatctcctcggtcagctccgccacgatggagcggggccagggagtgtaccagttcgtgtccacatcgggacccatggcaaagccgatcttgttgccgaaggacatgttcatgaccgtctcggcaaagccgtgctccaccgcccatgcggccttcactttcccggccttgtgcagttcgcggagcttgtcccaggccgccagagggtgctcggccagggcgtcgcccgcgaacaggtacaccgggtgccccgcctccttgaactcgggggagagcacctcacccgcctggatgggggcgatggcgaaggagatcagcgtggggggcacgtccagatcgtggaaggtgcccgacatggagtccttgccgccgatggcggcgcagcccagctccaactgggcgtccagggcccccagcagggcggcgaagggcttgccccagcgggtgggctcgtcccgcagcttctcaaagaactcctggagggtcagataggccttccggtagtccgcgccggcggccaccagcttggccacggaggcgtagaccgcgtcctttgccccctggtaggggtcggcggagagggcgtcgggatcgcagccccaggccatgacgctggcctgatcggtctcctgctccggctccacggggaagagggcggccatgacctgggccggggtgcgctgggtcttgccgccgaagggcatgagcacgctgcccgcgccgatggagccgtcaaaccgctcggtgaggccgcggcgggaggcgcacttcaggctggcggccatctctcgcagggtggagcaggccgccctctccggggcggcgtccgcctggggcacggacacccgggcgtgcttggccgcgccgttggtgttgaggaaggcccgggacaggctggccacggtctggccccgccaggtcatgaccatgcggggctccgccgtgaccgaggccaccgggtaggactccaggttctccctggcggcggcgggcagcagggcgtccacgtccgccggggccaccaccacggccatgcgctcctgggactcggagatggccagctcggtgccgtccagaccgtcgtacttcttgcgcaccgcgtccaggtcgatggacaggccgtcggccagctcgccgatagccacgctcacgccgccggcgccgaagtcgttgcaccgcttgatgaggcgggtgacggcggggtcgcggaagagacgctggagcttgcgctcctccggggcgttgcccttctgcacctcgctggccatggtgtccaggctggccttgttgtggctcttggaggagccggtggcgccgccgatgccgtcccggccggtgcggccgcccaggaggatcaccacgtcgccgggggcgggccgctcccggcggacgttggacgccggggccgcgcccaccaccgcgccgcactccaggtgcttagccacatagccctcgtggtagagctccgccacgtggccggtggccaggccgatctggttgccgtaggaggagtagcccgccgcggcggtctgggcgatcttccgctggggtagcttgccctccagggtctgctccaccggggtgcgggggtcgccgcagccagtgaggcgcatggcctggtggacgtatacccggccggagagggggtcgcggatgcacccgccgatgcaggtggccgcgccgccgaagggctcgatctcggtggggtggttgtgggtctcgttcttgaacatgagcagccagtcctgctccttcccgtccacctgggcgggcacgtggatggagcaggcgttgatctcctcgctctcgtccagcccggggagcaggccccgcttcttcagggtcttggcgcccagggtggcgatgtccatgagggtctggggccgcttggcggctttctccgcgccgtagacctccacccgggcggacaggtaccgctcataggcggcctttacgttgtcatcggcgatctccacctcgtccaggtgggtggagaaggtggtgtggcggcagtgatccgaccagtaggtgtccaccacccgcacctcggtgagggtgggatcgcggccctcctcgtcccggaagtaggcctggaggaaggcgagatcggccagatccatggccagggcgtactgggccagcaccccctccagacccgcgcggtccagggcggtgaagccctccagcacgggcacggcagcggggacggggtagtcctggcggagggtggcgggcttgtccagcgccgcctcccggctctccaccgggttgatgagatagccccgggccctggccgcctccggggcggtgagggccccctccagcacgtagacggtggcggcgcggacggtggggcgctccccgccgtgcatcatctggatgcactgggcgcaggagtcggcccgctggtcgtactggccgggcagggcctccaccgcgagcagggtgtgctccccctccggggcgggcatgacctcatcccacagggcgtccacctgcggctcggagagcacggtggtgcgggcggcggcatagaccgccgcgtccaccccctccacgtcgtagcggcgcagcacctgcacgccggtcagccccgtcaggcccagggtgtggcgcagctctccaaacagatgctccgcctccacggcaaagccgggcttcttctccacataacagcgaaatacgttccccatactctctttctctcccttatgtgatcttccagtcggaaaattgatggaatatgttttgctgggtgggcgtcagcccgtcgatccggctccactgggtcaaaacggaccagttcttgaagcagatgaccgcgaaggggggctgcccggccagatattcatagagctgccgggccggctccgtccgccactgggccacggcggcccggaaggcgctgaggcggttcagcgcctcggcgtcgctgtacttgccgtagttgagggcgccgccgggggtcaggaaggcggtgagatcaaagtcggcggtgagccgcacctcccccaggtacaggtcgaactcccccgccgtcagggcctgaaggtaatcgtcccaggccagggcccgcagctccacctccaggccggcgtcggtcaggttggcggccagcgtctccgccgcggccagccggtcggcgttgttgtttggggccacaaaggtgagcgccagcggccgcccctccttctgccataccccgtcggctctggtgtagccggcggcggtgaggagcggctccatggcctgggggggcgtagtccagcgtctgggccagcgcctcgtcgtagagggggctggcgggggagacaggaagggcggcgggctgggcgtggcgggagaactgggcggtggatacggcggcccggtcaaagccccgcagcagggcctgccgcacctgggcgctccggcaggggccgtcggccgtgttgaagccaacgtacagcatggtgctggtggggtagtccaccgcagcaaaggaaccagaaaaacccagggcattggtgcccgtcaggtcggtggagaccagggcaatgtcccgggtatcaaaggcatggatcagatcgtccgcctcctgaatggcccgcaggggaatggtatcccggggcagggccttaccctgccaccagtcggagcgggcttccagcgcgaggttctcccccgtgccggcgagcacgtagggccccgtacccagggggacgcctcccgtctccttgacgatggggatgtccagcagggcgggcagagcaccgttggcgcggctcagggtgacggtcaccatgccgttggcggcggcgatgtccgtcacgccggcgaagcgggcggagtagagggggctggtgcgggccaggttgagggaggccgcgatctccgcggccgtcagggggctgccgtcggagaaggtcaccccgctgcgggggataaaggaccactggaggccgtcggccgacacggaggcggaggcgcagagcgcctcctggggctgaaactgcccgttcagggcaaacagcccctcatacagcaggccccccagggccaggttggtgcggttggagccggtaatggggtggaacccggcctccgggtagcaggccaaggcgaactcggccgcctctggagagggggagacgctgggcgtgggggtgggtgtgggctccggctccggcgccggcccgcaggcggccaaacccaggcacagggccgccgtcagcagggcggctagaatgtttcgcaaacggctcggcctccttcctaaaggcgcgtcgattttctgcggaaaatctctgccgctgcgcggcaggatatgcgcctgcggcgcgataccccctccgctctccgagggaatgttggattggcgtacaacggcaatggagcatccatattttatagctgcttatctcacagtgttttccccgccctacggggaaacgaaattgaaaatcagtctttccgggaattcatgttccggaaagacaccccgacccgcgccacagggcgcgaaaccgggggtatcgagccaagccgccggcgttttcgccggcacgcaggctcgtatctaggggtcggaagcgccggtggcgcttccgatgaagtccagacggagtctcctcagacgccattggatgccccctagacgattgcgatcattgccgcctggctcccccgctccccgtgggtgtagcggtgggaccagtacttctccggcaggcagcaggtacagtcggcggagacagcgatgtgttcgaggtccagcccggcgttctccagccgcttggcgttgaggcccttgagatccacgtggaacttgccggtgggcagcacctcgatggaggacagggcggcggcccccatggcctcagtcatggcgttgggcacgtcctcgtgggtctcgaagcagcacttggagatgccggggccgacggcggccaggatgtccagccggtcgcagccgtagcagtccaccatgcgctccaccgccttggcggcgatgcccagggcggtgccccgccagccggcgtggaccgcccccaccactcggcgcaccgggtcgtagagcaggatgggcaggcagtcggcggagtagaccgccagcgtcacaccggggatgtcggtgacaaggccatccgcctgccagggctccggttcgtccaggccgatgcccagatccgccgcggtgacggtgcgcaccgtgtcaccgtgaacctggctggcgcagacaatgttccccatgtccgccccaatggcggcgcagaagcggcggtagttctcccgtacccggtcgggagcgtcgccccggttcatgcccaggttgagggtggcgtagatcccctccgataccccgcccaggcgggtggagaagccgtgtgccacaccgccggcggcctcaaagccgtcggcggtgagatacaccaggccatttttgttgtgctcgataatattcatggatttcctccatctggaaatcgaaatcggtttttccggaaactcgcgtttcgaaaaacacctcgacccgcgccgcgggcacgaagccgggggtatcaaaaccgctgtgccgcaaagcggcacggcggttttgtatctagggaccggaggcgcttccggtcaaacgccagcgaagccacattccgcttttggataccccatagactgcttttactcgtcctcgtgcatgccgcagcacttcttgtacttcttgccgctgccacaggggcaggggtcgttgcggcccaccttctggcccttcttgacgggctgcttcttaacggtgccgtcgctgcccgcgctctcgccggtgaccttggccacccgctcccgcttgacggtggtggcgcccacctggacccgggccaggaagatgcggcggatggtctcggcctggatggcggcgatcatgctctcaaacatctcgtagccttcctttttataggccaccaccgggtcgttctggccgtaagcccgcaggccgatgccctggcgcagctcctgcatggcgtcgatgttgtccatccagtactcgtccaccacccggagcatcatcacccgctccagctcgcgcatgaggggctcgcccagctcggcctccttgcgggcgtagatgtcgctggcccgctcctggagcaggtcggtgagggcctgggcgtcgtactgctggagctcctcgtcggtaaacttgaactcgtcgggccgcaggaacagaccgcggaactgggcgcacacctcccgccagttctcggcgtccatgtgcttgagctcacccatgtgggcctgcacctcggtagaaatcacggtggagagcatggcctgaacggactccttcaggttctccccgtccagcaccttgcggcgctgctcgtagatgaccttacgctgggtgttcatcacgtcgtcgtactccagcacggtcttgcgggtctggaagttgcgggactccacctgcttctgggcgttctcaatggcgttggagaggatcttcgcgtcaatgggggtgtcctcgtccacgcccagcttctccatcatgcccatgacccgctcggagccgaacaggcgcatgatgtcgtcctccagggacaggtagaagcggctctcgcccgggtcgccctgacggccggcacggccgcggagctggttgtcaatgcggcgggactcgtggcgctcggtgcccaggatgaacaggccgcccgcggcccgcacctggtcggcctccgccttgatctcgtccttgtatttggcctccgcctcggcgaacatcttccgggcgttgaggatctcctcgttgtcggtgtcggcgtagccggtggactcggcgatgagctcgtcggagaggccggccttgcgcagctcggccttggccaggtactcggcgttgccgcccagcatgatatcggtgccgcggccggccatgttggtggccacggtgaccgcgcccagcttgccggcttgggcgacgatctcggcctccttctcgtggaacttggcgttgagcacgttgtgcttgatgccccgcttcttgagcatggcggagagctcctccgacttctcgatggagatggtgcccaccagcacgggctggcccttcttgtggcactcctcaatctggttgacaatggcgcggaacttgcccgcctcggtcttgtaaaccacgtcggggtgatccacgcgctgcaccggcttgttggtggggatctccacgatatccagggagtagatggtgccgaactcctcctcctcggtcatggcggtgccggtcatgccggagagcttgccgtacaggcggaagtagttctggaaggtgatggtggccagggtcttggactcccgggccacggtgacgccctccttggcctcaatggcctggtgcaggccctcggagtaccggcggccgtacatgaggcggccggtgaactcgtccacgatgatgacctcgccgtccttgaccacgtagtcgatgtcccggcgcatcaggccccgggcccggatggcctggttgatgtggtgggacagggtggtgttttccggatcggccaggttggccacctggaactgctgctcggccttggcgatgccccgggcggtgagggtgacggtgcgggccttctcgtccaccacgtagtcggcgtccagatcggggtcctcctcctccttggtgtccacgctggccacccgctggcccttgagcttggccacaaaggcgtccaccacggtgtagagctgggtggacttgtccccctggccggagataatgaggggggtgcgggcctcgtcgatgaggatggagtccacctcgtccacgatggcgaaggcgtggccccgctgcaccatctcggtggcgtagatggccatgttgtcccgcaggtagtcgaagccgaactcgttgttggtgccgtaggtgatgtcggcggcgtaggaggccttgcggtccttgggctggatgtcgtggatcaccaggcccacggtgaggcccaggaagcggtagaccttgcccatccactcgctgtcgcgcttggccaggtagtcgttgacggtgacgatgtgcacgccctctcccgccagggcgttgaggtaggcgggcagggtggccaccagggtcttgccctcgccggtcttcatctcggcgatgcggccctggtggaggatgatgccgccgatgagctgcacccggtagggcttcatgcccagcacgcgccaggccgcctcccggcaggcggcgaaggcctcgggcaggatgtcgtccaggctctcgccattggcgatgcgctgcttgaattcgggggtcttggccttgagctgctcgtcggtgagcttggagtactccccgtccagggcttcaatcttgtccacgatgggtttgatggcgcggagctccttctcggagctggtgccaaagagctttttcaacagtcccatgcgtcttgttcacctttcttgttcctgtccccggcgcctcggctcccaggacttggatgctaattcagtttcctagtatatcatatcccatgtcaataaaaaaggggaaattatgaacaaacccagcgttttgcggttttccttcgcgcctgcggcgccagcacgcagggggcgtagatgagggcaccgggcccatagttgttgtccaggccgccgcgcctcccgctgtgattcgtccattataccaaaaaaatacggaaggttacaaattgcttttttccatttacggcccggcaggcagatggtacaataatgttgttcccatcacccagtgtaaaggagcgtaatatgaaaaaacggattgtgctgtccggcctgttggccgcggcgctgaccctgtccctgacggcctgcggcggggacaagatgccggaggagaccccggtacccacccccatccagacatccacgccggtgcccacccccactcccacgccggcgcctgccgctcccaagtggggggatcaggtctttgccaagacctttacctccggcgacggcgccacggtgctcaccgcctccttcaccctcccgctgatacagaacaccgacgcctgccccgccgggacggccatcaacgagtggtacaaggccgagggggccagccggatgctggaggcagaggaggcctatgagatggcggtggccgactacgacgtgtccaaggcggcggggttccccttctaccctaccacccaggagatgacctaccagatcgcctacgccgacgagaaggtgatcagcgtctgccgggacctgtatgtgtccagcgagggggaggcccatcccgccgtctttctgctcagtgagcagtttgacgccgtgacgggggaaaagctggacttcaccgacttcttcaccgacgccgacgccgtacgggcgcgggtggtggacgccctgttggaccagcggagcgagctggccgcggcggtggagcaggggacgctcacccgggacgccatcaccgccgcggtgcaggtggacaacttttactgtacggcggaggggtatgtgttctggctccagggcggcgccctgcccgccatgaacagcccgctctctgcggtgctgacctatggcgccatgaaggacgtgagtgtaaatggataacggcaagccccgggaggggcagctctgccgcctggtgatcgacggctacgccagcgacggcgccggggtggcccggctggacgggatggtggtctttgtccaaggcggcatccggggagaggcctgcgacgtgcgccttacccatgtgggccgcagcgccctctggggccgggtggaggaggtggtcaacccctcccccgcccgtatcttcccccggtgcctgcactacaccaagtgcggaggctgccagttccggcacatgaactacgccgaggagctggaggccaagcgcatccgggtggaggacgccctgcgccgcctgggcggggcggagatccacgtctccgccatcctgggggcggagcaggtagaccgctaccgcaacaaggcccagttcccggtggccaagggcccccgcatcggcttctaccgcccccggagccatgacgtaatcgacgtggacgactgcctgctccagggggaggcggccgcccgcctgcggggggccgtgaaggagtggatggcggagtactccatccccgcctacaatgagcgcaccttcaccggcctggtgcgccacgtgtatgtgcgcaccaaccgggccggccgcagcctgtgctgcctgctggtcaatggccggggcgtcccccgggaggtcgagctggtgcgcgccctgcgccgggccgagcccaacctggccggaatcgtgctgggggtgaacgagaagcacaacaacgtgattctgggggactcctaccgcaccctgtggggggaggacttcctgtccgacaccctgtgcggcctcaccttccggctgtccgtcccctccttttatcaggtcaacccggcccagaccgaggtgctctacggcaaggccctggagttcgccggcctcaccggggcggagacggtgctggatctctactgcggcatcggcaccatcagcctggtcatggcccggaaggcgggcatggtgtggggggccgaggtggtgccccaggcggtggacgacgccatcgccaacgcccggcgcaaccacattgaaaacgcccgcttcctctgcgccgacgcgggggaggcggcccgctacctggagggggagggggtgcgccccgacgtggtgtgcgtggatccgccccgcaaggggctggccgaggacgtggtggacaccatcgcggacatgggcccggagcgggtggtctacgtctcctgcgatcccggcaccctgggccgggacgtgaagcggttcgccgggcggggctacaccctcaaaaaggccgtggcggtggacatgttcccccgcaccgcgcatgtggaaaccgtggcgcggctggaacggagctgaggccatggcggaggagagacacatctgcgccctgctgcggcagggctgcggcggctgccccctgctggagaccccctatccggagcagctgcgccaaaagcaggcccgggtggaggcgctgctgggggagttcgggccggtgtcccccatcctggggatggagcacccctggcactaccgcaacaaggccatctccaccttctgcaccgggccgggccggcggctggacagcggcatttacgccgcgggcacccaccgggtggtgccggtggcctcctgcctgctccaccaccccgccctggacgaggcggtggaggcggtgcggcaggccgcccggctctgccggtacgagccctaccaggaggaccggggcacggggcttgtccgccatgtgctggtgcgccacagccgcgccaccggacgggtgctggtggccctggtgaccgccgcccctgtcctgcccggggccagggcctttgtctccaaggtgcgggagctctgcccgcgggtggagaccattgtgcagaacatcaatccccgccgctccagcgcggtgctggggccgcgggaaaaggtgctctggggcagggggtacatcgaggacaccctgtgcggggtgcggttccggctgggggcctccagcttctatcagatcaatccggagcagaccgaggtgctctaccgcaccgccctggacggggcggggctggacggcacccagaccgtggtggacgcctactgcggcgtgggcaccatcggcctggcggcggcggggcgggccaggcgggtgctaggggtggagttcaaccccagcgcggcccggtgcgccgcccagaacgcccgggccaacggcgcgggcaacgcccgcttcctctgcgccgacgccacggcctacctccagggcatggccgcccggggcgagcgggcggacgtggtgttcctggacccgccccgggccgggagcaccccggagttcctgggtgcggtggaccggatggggccggagcggatcgtctacatctcctgcaacccggagacgcagcggcgggatctccgcctgctggccggatgggggtggagggcccggctgctccagccggtggatctctttccccatacggagcatgtggagtgtgtggcggtgctggccaaaatccgcggaggtggtatgtgaggtacgccgcctccgaagtcaaaacagcatgggagcctggcgcgcaacgtgcggcgccaggctcccattttactttgtatgctacgcttccttcggcggcatggcggtagccacgcctttgatcaccacgtctccgtgctggttggtgcatacggtgtccagcttgacgatattcttttccggaaacagttcctggacggtacaggtcgccgtgacggtgtccccgatatagaccggcttggtgaatttcagctcctggcccagatagatggtgccgggccccggcagcttcatgcccagcactgcggagataaaaccggcccccaggatgccgtgggcaatccggccgccgaactgggtctggctggcggaaacctcgttggtgtgggcgggattgagatcgccggtgatgccggcaaacaggtatacgtccgtctcggtcacggtcttggtcacgctggcgctgtcgcccagcttcatttcccgaataagcattgtttgacctcctgttcctgcgttgttccgcttgagctggggttctgctgcgcaagccccattcgctcctcccggaagatgcggctgtccatagtcgttacatctgtgatgactggtgtgaactccatctggtcaaggatatcgcgctggatgtccacgcccggggcgacctctttgagcgcgacgccctccggtgtgagggcaaacaccgcccgctcggtaatatagaggacgggctggttatgcttgattgcgtagcggcccgcaaaggtcacctgctccacctgcctgaccagctttttgaccttgccctcccggaggagcttcagcgtaccgtctgcggctgagacctccaggccgccggcggtgaaggtaccgcagtagaccaccttcttggcgttctgtgtaatgttgatgaagccgccgcatccggcgatcttcgggccaaatttgctgacgttcacattcccgtccccgtccatttgggccaggccgagaaatgccgtatccagtccgcccccgtcataaaagtcgaattgaaccggctgctccagaatgcagtccacattggtggcggcgccaaaatccatgccgccggccgggacgccgccgacggcacccacctcggttgtgagcaccatgctctccagcccctcctctgccgccacagaggctacgccctccggcatgccgatgcccagattggttactgcacagggggtcagttccatggccgcccgccgggcaatgatcttccgcgcacccatcggcagcggggacagagcattcagaggggtgcggatctctccggaaaaggcggggtcatactgggtgccgaaggtctgcatgtggttctccggccgggccaccacaagcgcatccacatagataccggggaggcggatgagccgtgcgtccaggcagccgtaggagaccaccttctccacctggacaatgaccctgccgccggagttatgggcggcctgcgcctgggccagggcctcggcgtagacaccctcccgctcaaaggtacagttgccgcgctcgtcggcataggtcgcgcggataactgcgatatcaatggggaaggcgggataaaagagcttttcctcgccctccagctcaatcagcttgaccatatcgcccgcttcatgggcggcgcggttcatctttccgccctccaggcgggggtccacaaaggtgtccaggccgacatgggtgatcacgccgggccgcttcgcggcgatctcccggaacagcccggagatgacaccctgggggaggttgtaggccgccagcttattctccgccgccagccctcccagcttgggcgccaagccccagtgtccgccgatcaccgttgtgcacatcccgtctacagccaggtggttaagcccccgctcgccgctgtcaccctgtccggacgcatacacgaccctcagccctctcgggtgtccgctgctcctggcggcctcctccagcgcaaccataatctcctccggatgcatcagaccgtttgcaaagccgccgaacgtcacagttgccccatcgtaaaaataggtgtctaccgcttggcgggcggttaatatctttgccatatcgtttcgttccctttctgtaacatagaatggctgttttcctgaaggcaaaagcggaacgggtcggcatccgattgcgcggtgctgacccgttcggaccggtccgttttatgtggactctgagtgatcagatcagcccgatgattgccattgttgcagcgatcagcgccagggcgatgggggtgatcacggtcatgaccagtacgtgagggtaggactccttggtggtcacgccgcagacctgggcctccataacgaaggtgggacagtggggcagcgtgtccatgcccatcgcggccatgccgacgaccttgtagagcgcctggggattgacggtgcccagggacatgaactggtcggccatggtgctgcagaagatctgggtgccgctgagggaggcgccggtaataccggaaaatacgttggttacgatgacggcggagatgtaggggttcattttgtcggcgagcatcatcgcaaagttcatgaagtactggaaaccggcgcaggcattgacgacggacgcaaagcccatcagcgcggcggtcagcagcaggggattgatgctggaggtaaagcctgtaaccaggtcctgaacaatgtggcccttgagatacttataattggtaataattagaacaatagcgcccacgcccatggcggtgttgatgccgtcagaggcgctcatggagttggccagcaccagcttaagcacaataatgacaatatagggcagaatagccaggtgaatggggggcagttccttaccgctggtgcttccggcgatgagttcggcatcgctctcagaggctacaaagccaattccacgggcacgcagggagttggaggcccaggtgaagtagaaaatgccgaagccgaaagccactacaaggagcacaattgccatcgtgggggccgcaaaggtggtgacgcccagcttttcggacaatgcgatgcacagcatagagggggcgcccggggtaacgacattcagaaccacggctccatacaggaagatggcgggcatcaggagttttgagacattggctttgcggaacatgggcacagccacgggatagacggcaaaaataataataaatgcatttacaccgccataggccaaaaggaaggtaataatcagggttccggcgacggtggctttcacgccgaggaaggcgaacagaaaatttgcgatagactcggcggcgccgctctttttcatcagctcgctgtaagccgaaccaatggtgaacagaaacaggtacgagccgaaggtacttccgagggaggccgcgtaggtgccggtcagagtcccccagaacgggagcccgctgcttacaatcacgataaccgagccgaccagggatgccacaaagccgttgacacccttaaaggtcaaatagatcaggactgcaacgccaagaaccatgccaattacgctgatgatctccatacgttttcctctctttcttatccaatgattccgtactgggaggcgctcgcttaacgctaggtcaggacagtaaaagcactatatttccattaaagaataataatggaatttaaagggcggacaagctccggaggtactctggcccgtcccaatttaccaaatcatattccgttcggcctcttctctcagccagtcccggaagtccgggtgggcaattttgaccagggcctcaacccgctccctgatattcagtccccgcagccaggcgataccatactccgtgaccacgtagtcggtgtcgtttctggaagtggtgaccgcggcgccccgcgccaggaaggggacaatttttgagtgcagcacctctttgccgtctgcatctgtggccgaataggtggaatgcattgcaatgatggatttcccgcccggggacatctgcgcgccctgtaccgtctcagactgccctccggtgccggaccactgaaggttgccgacggtttcagaggcgcactgtccggtgaggtcgatctccaggcttgcgttgacggagacaaacttgttgtttctggcaatggtgtagggatcgtttgagaaggtggaggatttaaagagcacggaggggttgttgtggacgaagtcatagagcctctggctgcccatggtgaaggagcacacggaaaaaccgttcataaagcccttctgggagttgtccaccgcgccgcactcaatgagatccaccatggtctcggtaaacatttccgtgtggattcccagatgcctcttgctcctcagctcatttgccacggcgtttgggatgttgccgataccgagctggatggtggagccgtcctctacaagagaggccacaaaggcgccaatttttttgtctacctcggtgtagggcaccagggacttggtggggatagggcggtcggactccacaagggcatccacctcggaaatatgtacctgtgtatcaccaaaggtgcgcggaaagttggggttgacctccagcagaaccagcgcaccctgatcgatcaggtcccgctcatagattgcgctgaccgagagggaaaagtagccgtgggagtccatgggggagaccgtggccagcaccacgggccggcggccctcggcctgcaggcgctgtagagactttcgcagaacggaggtggagctctgaggaacggcgctgaccagcttctttttctgcgcgtcccggagcccggcggtaaagaaccagccgttgtggctcatgatacctgccatctcggggtccttcatcgcatcataatactgaatgggaaggcaggagttcaaagtagtgccttttacccccgtctccttcaaatgctgtagcttggacaggatggcctggggctccgccgcagcctgagcggaaaacatggaatctccgtcctgaataagctccaaagcctgttcagcgctcatttgtttcttcttgtacaattcctgatactggttcacaggataacgctcctttctcgtggggccatgtctggtgcgtgggacagggcgcagaggaagggaatgaaccccgccccacacaccgccttttgaggaatttgtccggttatggggattttgtcttgcctgcttcgacaatttgattatagttgaagggctatggtttgaaaaatacaccttttttatcgccgcatgaattttggttatgcctaaaataatgttgctgttttttgaactttagccccgttttattggaaattatcctatattatagtctgttttttctctctggctagtggcccggcactctttgccgcatcccgtgttccgaaaagaaatttgcgaaaaggcgtcatgtactttataataaaaatacaattcgctcgactgttcgaatggttttttgtgtaggaggaatcatggctttgcggcatcacggcctgcggcggctgagggagtatgtatgaaacgaatgcagctagaatattttgtgcgtattgtggaggagaaaagctttacaaaggccgcagaaaagctctttatcagccagcctgcactgagcaaatcgatccgcgcccttgaggcggagcttggtgtaacgctgttcaagcgcgatccccgcgagctgagcctgaccagcgaaggggaaaacgtctactgttatgcggtggatattttgaattactggcaaagccgtaccgccgagctgttttctttgctggaacaggtaaagggttctctgcggtttgggcttccaccgtcggttgggagcgtttttttttcaaagattctgtttgaatacggctgtaaatatccgcaggttgatttgcagattgtagagggaacctccaaaaagattgaagcactggtcatgaatgatcaggtagacctgggcgtggtgattgagccatacgaaaatccgcatatgaggttaaagaccgtctaccgttctgatgtggtgctggcagtggcgcggaatcaccggcttgcagagcggacagaagtggagattgccgagcttagggatgagccgatgctgatggtctcgaaggactatatgtttcacgaccaggtgcttgcccattgccggcaggcggggtttacgccaaatatcacgtttaccacatcccagtgggaccttttgctggaaatgacggctgaaaaccagggtgtgaccctaattgggcggcctttggtggaaaagctgtacagcggcaggatcaagtgcatctcacttcaaaatccggagtttttgtggacacttggcttaatatcaaaaaaatgtaaaacgctttccggcgctgcaaagagcctttggaatttttgcgatgaagtttgagggggaccagacatcacagccggctgcaaacctgcctgctccatctgaaaaacgccggggacagaactgtaccgcacagtcctgtccccggcgttttagaacattctatatgtgagggccttccgtacgaggctccggagggcctattccaaatcatatacacaatatgaaggaacgccccgcctcccgttcgggaggcggggcgctctgctggccgggcacgggggacggggggaggacataggataggatgcagagaaaacggcccgacagccgctctgccaaatgctctgaaaaggagaatgccgcgtgtcagaatattgtatgcctccccttggggggtattccaacggagagtgcgccatgaaccgcatcaatgcccagccggagcggcggccctgcgtgtgctccccctgccatccggttccgccctgcccgccaattccaccctgtccgccgactccccctcccattccaggcccgaccggcccggttggaccgaccggccctcaggggattccgggaccggacggtcccaccggccctgcgggccccatgggtccccagggcgggacaggtgatccaggccccaccggccccaccggcgccgtgggtctgacgggtgcgacgggtcccgcaggcccgacagggcccactggcctgacgggtccgacgggcccaaccggccccaccggcgccgtgggtctgacgggtgcgacaggtcccgcaggcccgacggggcccactggcctgacgggtccgacgggtccgaccggccccaccggcgccgtgggtctgacgggtgcgacaggtcccgcaggcctcacggggcccactggcttgacgggtgcgacgggtccgacgggcccgaccggccccaccggcgccgtgggtctcacgggtgcgataggtcccgcaggcccgacggggcccactggcctgacgggtccgaccggcccgactggcccaactggcccgactgggccaagaggcgagacaggcgcagcaggcgccacaggcccgaccggcccgtccgtgaccccggcgaccgcagtggcgaacgccaccagcgccgcggacgtggtgacacggtttaaccagcttctggaaaacctgcgggcggccgggctgctgggcacctgagtacaggcaccaaaaaaacgccgcgggcggcgctgctgcgccgcccgcggcgttcctataagggggattgctttgtgaagattgtggtttatgccatttgcaaaaatgaggccggacatgcggaacgctggatggcctccatggcggaggcagacggggtgtatgtgctggacaccggctccaccgacgggaccgcggagcgcctgcgtgccctgggggcggtggttgtggaagagagggtggagccctggcggtttgacacggcccgcaaccgctctttggagctggtaccggaggacgcggacatctgtgtgtgtaccgatctggatgaggtgtttcacccgggctggcgggcggcgctggaggcggcctggacggacgggaccacccaggcggtctaccgctatacctggaacttcaacgccgacggctccgagggcaccgtgttctggattgagaagatccacgcccgccggggataccgctggacccacccggttcacgaggtgttggagcggcaggagggctggggaccggggcggaagtgcacagcggagggggtgcagttggaccaccacgccgaccccgccaaatcccgggggcagtacctgcccctgctggagctgtcggtggcggaggccccggaggacgaccgcaacacccattacctgggccgggagtacctgttctacggccggtgggacgactgtatccgcacactggagcgccacctgtccctgcccaccgccgtctgggcggatgagcggtgcgcctccatgcggtttctcgcccgggcgtggcggcagaagggccggccggagcaggcccggcggtggctgtggcgggccatcggggaggcccctcacctgcgggagccctacctggagctggcgcgcctactctatgaggaggcggagtgggacggggtggtgtacctgtgccgtcaggccctggcaattaccgaccgccctcagacctatatctgcgaggcggaggcgtgggggagcctgccctgggatctcctctctctggggctgtaccacaccgggcggcggggcgaggccctggaggccgcccggcaggccctggccctgtctccggaggatgggcgcatccgggacaacgtggcattcctggcgggctagctctcccgggccgccgccgtccggcggcgggacagcgcgtccagaagccagggccataccagtgcaaagaaaagaccaaacagactgcccagcacgttgttgcatacccggatggcggccgcggggccgggaccgaagagggcgctggcggtgagcagggcgcccagacagttgaacacggtgcagaagccgtagctggcgcacaggcccaggcagagccccgacaggatgcccaggccgccgtggagggcgggcgggcagagctgatagagcaggcagaacagcagggagccgcccagcacgccgcccacccggcctgccgcccgccggacggggtgggacccgtaggcggtgagaatggagctgcacgagaagcccacccacatgatgcggggcaggcccagcagctccccagtgagcaccgccaggctgatgcccacggccacccggagctgccagcggcacttttcatcggcgagggaaaaggcgcggagtaccgcccggaaggggcgctccggtgtcctgccccggtggttatggtagagcaccgcggcgcacagggcgaagcccagcagcatctccagcccccgcagggcgagcgagcgcccgctgaccggatttccatacaggaaaagatagctgaacaggtagagggaggcgttgcccagctcgggctggtcggcggtgatgagcagcagcactccgatacagaacaggttgagaagcaggtggagcaggggcccgcccagaggggccagggcgggcccgagcgtgagcagggcgaaggcggccgccatgttccgcagggtgtcggccatgcggtagttgtaatggacaaagcggcagctgagcagcagacagaaaatgaccaccgccgcggggctgttggccccaccgaacagggcggtgagggcggagataaacaccaccgcaaaccccacacaggcggcgtcccgggccagcagggccaggagaagccgcctgcgctcggccccggcggcctggcggagcaggcccttgagctggggcacccccaactgcatcagtccatagaaggacacggctccccaccccctttcacggccgcggcgtccaggcggcggttggcctgggtgatctcctccatcagccgggtgaactccgcctcccccagcccctcccgcatccggtagaggggggagagatacgccctgcacccgtcctggagggcctgccgtcccgcctgggtgagagacagggtatagctgcgccggtcggtgggggagggggcggccgccaccagcgcccgcgcccgcaggccccggatgaggcggctgacgttcacctgctgtaagcccatgctccggctcaggcccaggggggtcaccggctcctccgccatccacaggcgggcaagcagctccagctccgacccggtcaggggcaggcgctggtggacggcggcccgccgggccaactgccgcagctgctgcatatactctgacatttgaacccaatccggtttcacaaaatcgtcctccatatacttatctataatatatattattgataagtatattactccgccaggcgcatcctgtcaagagcgccctgcgcattgacattcccgcggagaaaatagtataataaaaaatacgtaccggggcatggccccgttgggagagaaggatacagggggcggagcgcatatgagcgataccaatgataaaattcggattgtgcaggagacggtggcgggcaaggagatcacctttgcccacgtcatcggcgggccggcccccatcatctatcagaagctgggcctgaacccggccatcgactacggcgccgccgccatcggcatcatgaacatgacaccgccggagtcggcggtgatcgccgccgacatcgcagtgaagagcggcgacgtatacctgggctttgccgaccgctttaccggcacggtcatcatcacgggcgagctggcggacgtcacctctgccctgacggagattgtaaactacttccgcgatgagctggggtatgtggtgtgcaggatcaccaagcggtaagaggcgcggcgatggggaagcgtatgacacgggaggagttcctggaggcggtattctcccggcggtatgaggaactcaagggcagggagctgcgtacggtccgggtccgggtggtgggcaaggagctctctctggcccagctcatcggcgtgacggaccggcgggtctatgagaacctggggctgcacatcggcacccatctgggggaggatcacaccggccagtccatcggcctgctgcacctgaccccgtgggaggccacggtggtggccgccgacgtggccatgaagagcggaaacgtggagctgggctttctggaccggttcagcggcgcggtgatccttttgggcagccgggcggaggtcaagagcgccctggagcatgtggtggaatttttccggacggagctgggcttcaccgtctgtgaacttacggagcggtgacaaagagagatgaagaagttatttctgatgggccggagcgaggcgggcaagacctccctgacccagattttatcgggcgaggagctgcactaccacaagacccagtacaccaacacggggacggacatcattgactcgccgggggagtattcggagaccaagcggtgcgggctggggctggcctgcttctcctttgaggcggacgtgctggccctgctgatggcggctgacgagcccttcagcgtttttgaagccaactgccagtgcttcaccaaccggccgctcatcggcatcatcacgaagattgactccccctacgccaacgtgcccatggtgcgcaactggatggtcaactccggctgtgagcggattttcgaggtgagcaaccttaccagggagggcattcaggagctgctggactatttgcaggaggaccctgtcaggctgacgctggagcaggccaaggcgcggcagcgcctcggcctgacggagtgggaggacgcctcccgcttcgggctggcctgaccgccccggagcggagactgccccgcagggcggttcggagcgccgccgccgctttgcgccggcgcttggcgcggggatgaaccgtcagggttccctttcatgccggatcaaacgacttttagaaacggttttaaagatttaaacagtcttccagcctgtcgaaaagagggcttcggcaggctgagggccgcgcccatggcgcggcccgtttgcgcgttttggggcggatgcgcatccccttctggacaggccgcttatttcgtgttaggattacgtgaagaacattccgcccgaattttgtcgggcgatccgcaactttttgcaggctgcccgcgtctgtacgttggcacggaaaggaggcccaaatgcgcctgttgttcaagcagcggtttctctcctggtttgacagctatgacatctatgacgaggaggggcgcaccgcctataccgtggagggcaagctgtcctggggacaccggctggagatctacggcccggccggagaccacctggggacggtaaaggaagaagtgctgaccctcctgccccggttcgccctctatgcgggggaggaatacctggggtgcatccgcaaggaatttgccctgtttcacccccggtttacactggactgcaacggctgggaggtggagggcagctttctggagtgggactacgccgtcaccgacccggcggggcgcacagtgatggccgcgtccaaggagctgctccactggaccgacacctatgtgctggacatcgcccggccggaggacgccctgctgtgcctgatgatcgtgctggccatcgacgcggccaagtgctccgccggaaacggctgaaccggccgccggaggaacttggcgcggctaaatcccggcctgtgtggaatagtagctgtaccacacaaggaatcggggtatgctgctatgctggaatccgccgctgtccgcgcgctgttgctgtccctggccgccgggctgtccaccctgctgggggcgctggtggtctttgccgcccggagaaggagtgaaaagctgctggcggtctccctcggctttgccgggggtgtgatgctggcggtgtccttcaccgacctgttccccacggcgcgggagcacctgactgcatccctgggcggccgcccaggggcgctggcggcggtgctgtccctggccgcgggcatcggctgcgccgccgccctggaccacctggttccccacgacgcctttgacgccgacaccggcgaggccccccacaaaaacctgttccgggtgggctttgtgtcggcgctggccatggccctgcacaacttcccggagggcgtggccacctttctggcggggtatgaggatctgaccctgggggtgagcatcaccctggccatcgccctgcacaacatcccggagggtatttcggtggccatgcccgtgtggtacgccaccggaagccggcggcgggccttccgctgcaccctgctctccggcctgacggagccggtgggggcggtgctggcctttgcgctgctgcgtccctttctcaacgggctgctgctgggggtgctgttcggcgcggtggccgggatcatggtctatatcgcggtggaagagctcatcccctcctcccggcagtacggccacgaccggccggccctgtgggccacgctgtgcggcatctgcgtgatgccgctgacccatttatttcaaacctgaaaaggcgggtgtatcccacattggagctcgactacaacaagctgctggacatggtcagtgagatgggctaccggctcatgaagagcggtgcggagatctaccgggtggaggagtccattcagcggcttctccaggcctacggtgccccacggggggaggtctttgccattcccaactgcctgatggtcagcctgacctcccccgacggccggcccgtgacccagatccgccggatgccaacccacggcaccgacatctacctgctggagaagtacaacggcctgtgccgccgcctgtgccgggagacccccgcctttgaagaggcgctggagcagatggaggccattacccgcacccaccgggtctactccctgcccacccaactggctgcccacttcctgggctgcggcatgttctccctgttctacggcggaaccccggccgacgggctgtgcggagggctgtgcggcatggtcatcggcctttgtatggcgctgatgacccggctgggcgccaacctgttcttccgtaccatcgccggcggcgcggcctccgccctggcggccgtggcgctcacccggcttggggtggggcagaaccaggacctcatcatcatcggcgcgctgatggccctggtgcccggcatcgccatgaccaacgccatgcgggacatcatggccggcgatatggtggcgggcatcagcaaggcggcggaggcgctgctcatcggcgcggccatcgctctgggcaccgccctggccctgggcctgacccggatggtgacgggaggcgcgctatgagagaggcccttctttatctcctgccctgtgtctacgccttcctggcctgcatcggcttttccatgctgttcaacatccacggcgccggcatgctcatctgcgccggcggcggggccctgggctggctgtgctacctgctcaccgggccgctggtgggcaacgatattatccagtccttttttgccgccctggtcatctcggcctggtcggaggtgatggcccggctgcgcaagtgcccggtgaccagctacctgctggtggccctctttcccctggtgccaggcggcggcatctactacaccatggaacacgccctgaacggcgacaccgagctgtttctggacacactgatgcatacactgggcctggcgggcgcgctggcggtgggcgtgctgctggtggcctccgtagtccgcctgttcaccacctaccagtcccgccgccggggctgagagaggagagataccatgccccgctatgaggttgtcctgtttgacgcggatcatactctgtttgactttgaccgggccgagcgtgaggccctccgccagacgctggaggaggcgggactgcccgccgacggggagaccgaggcgcgctacttatccatcaaccgggcgctctggaaccggctggaccggggtgaggtgcgccgggagtggctggtggtagagcggtttgccgccctgctgcgggccctgggccggacgggagatgccgcggccctcaaccgggcctacctggaccacctgggggagggctcctacctcctgccgggggctcaggcgctgtgccgcgccctggccccccgctgcaccctggccattgtcaccaacggcgtggcccgcgcccagcgccgccgcttcgaggcatcccccctgaacggcctcatcccctggctgtttatttcggaggagctgggggccagcaagccagaccccgccttttttgccccggtgctccgtacactggggaatccagacccccgccgggtgctgatggtgggggacaacctcctggccgatatccaggggggcatccaggccgggctggacacggcttggtacaatccgggccggctgcccggcgaccccgccatcgtccccacctgggaggtggacggatacgcggcgctccaagcgctaattctcaaagaagaaaaaaacaatatttaatcgaggtgtcccagttgccatcccaatatcagcccaaacgggcgcaaaacaggccgcgcaggcacaatccgctgcctctgctggcggcggccgcggcggtgtgcctcggcctgatcctgatcccatctctgggccgtgccccagaggagcccaccgccgcagcgagcccgcctgcggcggccactcccaccccgacagccgcacccacgccggagcccacacccacgccggagccgacccctgcggcctttgatttcacccagcccgcccctgccgccgaggcggtggagatggattactttgccgatgcactgtttataggcgactcccgcaccgacggcctgcgcctctacagcggcattaagggggcggacttttactgctacaagggactgaccgtgttcgagatggacgaccgcgccgtggtggagctggacggcggcaagtacacggtggagcaggccctggagaaggggccccaatacgccaaaatctatatatccctgggcatcaatgaactgggatattttaatgatgaggcgttccaccagacctttggtgatttcctgaagcaggttaaggccagtcagcccggcgcggtggtctatctggaaaatctggtgccggtgaacgcggagaagtgcgccgccaacaagcagccttactatgtgaataacgaccgggtggccgcctacaacgccatttttccccagttggctgaggagtaccaggtagtgctcctggacgtggcggacgccctcaccgacgaaaacggtattctccccgccgacgccaccgtggacggggtgcactttaccaaggcatggtaccagaagtggctggcctacctgatggagcacaccgtggatgcggactgctatgcggcgggccagaccgccgcggaaggagcgaatgaaacatgaaatccctgttgatccgcctgatgccggcggccctgctgtgcctggccctcaccgcctgcggaggcggcggggcggtgggccagaccccctatgacccggagacggccgcccaggccctgctggactccggcgcgttcagcgatgccttggacaccgtagaccaggacaccgccgccgccctgtacggaattgatgctgacaccatcaccggcagcgccgtctacacctccctgtccgccggggcggaggagattgcagtgctggtgctcaccgatgaggacgcggcagcggccgccctggatgggctggaggccagggtagccgaccagaaggctgtgctggagagctaccagcccgacgaggtctccaagctggacagcgccattgtggagcagcggggcaactccgtcctgctggccgtggccgccgatgctgaaaaagcccgggccgccctggacgggctggagtaacctgcgtccccccaaaaaagtgccgggtaccggcactttttttcaaactttttgggctggtgccgcgtctaagcaacagaagcaggaaggagcgcccggaccttggaacagactgtccgccagcagttgagcgactatattgtggctcaccaggaggaattttaccgcctggcgtacagctatgtcaaaaaccgggatgcggcgctggacgtggtgcaggagagcattgtcaaggctctggccaagtcggatacactgcgcaggccggagtatctcaaaacctggttttaccgcatcctgctcaacgagagtatgaaccaccaccgccgcgccaaacggctggtacccctggaggacaccctgctggaaaccccggtgcccgcccgggaccccggggagaggctggatctctatgacgccatcgagcgcctggactggaaggagcagaccgtggtgcgcctgcgctttttcgaggacatgaagctggaggagattgcgcgggtgaccaacaccaacttgaacaccgtgaaatccaggctctataagagcctgcgccgtctgcgggagctgacagaggaggagtgctgatatgccggatatgtgggaacgggccagggtgcgccatgagagcacgccggtgccggaggagctggaatttgccgtagcctctgccttgcgggcgggccagcggcggctgcggggccgccgggcgcttcgccggagcgtgagcggggtgctggggggctgcgcctgctttgtgctgctggtcaacgccagtccggcctttgcccgggcggtgtccgacgtgccggtgctgggcggtctggcccgggtggtcaccgtcacggagtaccacatcgacgagcgggagcgccttatcgacgtgcgcctgcccgccctggagctgcccggggacaccgacctggagcagcgcattaacctggccattcagacccgcatcgaccaggtgcttcaggaggccgaggaccgggcgcgggccatccgcgacgcctatgtggccaccggcggtgcggaggaggacttcatccccgtcatgatcgatgttgactacgagatcaagtgtcagaacgaccattatctgtcctttgtgctcaccgagacggaaacccgggccaatgcatacaccgagctttatacctataacattgacctccaggccgggcgggagctcaccctccgggatatgctggggccggactataaggaactggccaacgaggccgtgcgggcgggcatcgccgcccaggaggcggagagccccgacaacatctacttccacggggaggagggggtggagggcttcccctccatcgccgatgaccagcgcttttatatcaatgaggcgggcaatccggtattgatttttgagaagtatgagattgcccccggctacatgggccagccggaatttgaggtgcccatgcccaagtaaccggatgggccgccggagcgccgtgcgcgggagctgtatcagctcccgcgcattttttattcctgcgtgccggcacagacagggaaaaagacgctgtgtataaaattgcagaaaaataggcctctgttggaaaggatatgagattggaccgtaaaacagcggtttatccaaaggaaaagggagaagaaagccgcctggttatgcatatttatgcttgacaaatggggcttgcagtggtatcttttatacataaatattcgaaaacatacgaatattatacactgtaagaggaaagagtaaggtgaagagcatgaagaagcacaaaacactcggcaacgcgctgtccatgctgacggcatcggcgctgctcctgtccctgtgcgtcatcccgtctgcggccgcagacagcgcagcggcccccgccgctgtgtttgagaacaccagcggtgacggcgggagcaacggcatctccctgtccgccgagcggaccttccaggccagcatcccggtggacatgaccgaggccgaggccaaggaggccgcctcctccgtgacctggaccctgacgcccgatgcggacgcgccggattacttggacgatacccagtttcccaaccagaccgagggcggtcccctgagcgcctggctgtgccaggacggcgagacccccctttttaccgacgtggccaccgccgccgagacggtggacggccaagtgtacctgaccgtcaccttcgccaaccagtgctacttcggtgacgatctcagcgtgccccacagcaacggcggctcctatatggatgtgtgcggctacttcacgctgtccgccgggctggacggcaagaccctgggctctgtggatctgaaggtggcgccctacgacaacttccacaccatgtcggagatctatgacgagctggacgcgctggtggactacgccgccggccacactgacctctacgtggagcagttctccatgggccagagccagggcgacaacggcctggaaagcctggatatgccttatctgattgtggccaaggacaaggccgcggtggataagtggcaggagatcaaggcggaggcggagagcgatcccaccgccctgctgaagaagctggagagcggcgccctgggcgactaccaggtgcccgtcatgtactccaatattcacgccaatgaggtggccgccagcgacggcatcctggcctttgcctggatgctggtggagaccgcggcctctgagagcggcaccatcgactacgacaagctcaccggcttcaccgccgccggtaaggccgagctggccgagcagatgggccctgcgggtgaggagggctccgtggccgtccccgacctggtggccaatgacgccacctacctgggctacatcaaaggcgagaacgccgacggcaccaccgcctccatctccacccaggtggagctggagaaatactacaccattgacactgtgacggtggacgtggacgagctgctctccgacgtgttcttcatcatcgtccccgaggagaacgtggagggccggacctacctgacccgtacctcctccggcggctttgacctcaaccgggacaactccttccagacccaggccgagacccagaacatggccaggctgatcgccgagtggaaccctgtcagcctcaccgagttccacggccgggtgcaggccttccagtgcgagccctgcgatcccccccacgagcccaactttgagtacgatctgctggccgagcacctgatgggcggcggcgaggccctgggcatcgccgcggtggccaacaacggcggccacaacagctacgtcatcccccagcgggactacctgacctacaccggggcgaagaccgccgacggggacgaccagacccagtggctcgacccctgggacgacatgtccaccagctacaccccccagtacgccatgctccacggcaccgtctcctacaccgtggaggtgcccgcctatgacgactacatggtgcagggcgtcgcctacggccagctgggccagtccgtctacatcgccgagcacaaggacggctacctgaccaaccagaccaagatcttcgagcggggcgtgaccaacgccaactccgacgcctacgagctggtgggccagtggttctgcgaccagtacgacgtggagggcgcggaggccgacctcttccggcctgagtacgacggggagggccagaacggcaatttctaccccgagtgctatatcattcccatggacggcgtccaccagtccaacctccaggccgccgccgagatgatggagtacctgacccgcaacggcgtccaggtcagcctcaccgaccagagcttcacctacaacggcgtggagtaccccgccggcaccctaatcgtgtccatgtaccaggccaagcggagcgtggccaacggcgtgctgtacgacggcaccgtgattaccggctggcccgtcctctactccgagggcatcaccgccttcgacaaggtgcggggcttcgacatggtggtgtgcgccgagcccgccgcctataagaccatctccgccgcctgcggcgacgtcctggactacgaggagaccctggattacgtggcctccctgacctcctccttctccggcgtgaaggacgcccaggtggtgctcatgaacgcctccgaggactccactgccgccgtcaacgccctgctgaaggccggcaagtccgtctccctcatcaccgagggccagtacgagggcagcttcctggtgtcctacgccgactggcagagcgtggcgggcgactacctgctctccggcgtgggcgtgaccgacgcccccgcggccctggccatccccaaggcccccgtggtctacatctccggcaagcccgccgacaacgacaagggcttcgtcaagaccaccctggtcagcggctcctacgagtacaactacgaccggcaggccatgcgcaccctgggcttcaccgtcaccgacgacgcctcccaggccgacctgatcatcggcgcggccgccctggacgagcaggccctggccgccgtcaagagcggcaccccctacatcggttacggctccaaggccatgaagtccgccgtctctctctttgacgagggcgcgctggtgcgggagaccgtcagccccaacgccatggatgccctggcctacgtcacctaccccaccgacagcctgatcaccgccagctatgtggccgagggcgacgacctcctctacggctacggcgccggctacttcgccgccatccccgccggcgcccaggtgctggtgcagctggacggctccaaggagctgctggagggcttcctccccgccgacggcgagcacttcgacgacttcctggacgactccatccaggccatctcctaccagggcgcgggcgcggacaacgcccaactggacgtggtgctcttcgccaacaccctgaccaacaagaccaaccagcgggatgagtacaacttcatctccaacgccgcctgggccgccgtgctgaacgacaccggctactccgacgtggcccccaacgcctggtacgccgaggccgtggccgccgtcaccgggcagggcctgatgaacggcgtcacctccaaggccttcggccctgacgtgactaccacccggggcatgctggtcaccgtcctccaccgcatggcgggcgagcccgccgcctccgcctctgccggctttgccgacgtggccgccggctcctactgcgccgctgccgtggattgggcctatgaggccggaatcacctccggcgccagcagcaccggcttcgcccccgacagcgccctgacccgggagcaggccgtcaccctgttgtgcaactacgccgaggcccagggcctggacgtgagcgcggccgccgacctgtccggctaccccgacgcctccgccgtgtccgccttcgcacaggacgccgtggcctgggcggtggacgccgggctgctcaccggcaccggcgcgggcaccctgaacccccagggcactgccacccgggccgagctggccgccttgctggtgcgggccgaggccctctttaccgccgaataacctccacataggctgggccgggacagcgttgctgtcccggcccaggaggctatcgataaatcctcctattaaagaattcggagggaaggatagtgtgaaagggaaccgtcagggttccctttcgcgttggatcaaacaactttttgaacctttttgaaggttcaaaaagttcagcagcctgtcgaaaagacttttcgacaggctgctgtcccggcccggttgttttgcccgccggtttgtgctatgctggggacaggaaacgcaaagggggatatttatgcacaaccagaatgaggcctttctccacctgaacgacgccctgcccgccgacatcgcccgccgcagggatatgggggatctggcgggggcgctccggctgatcgacgcccggctctcctccggcgtccagcccctgctggccccccggctggaggcggagcggctgcggctgacccgcctgccctacgactacccctacacccgccccgaggcggtggccctggtacgggcggagtggcccggctttaccgaggcgcagttcgacgccctgctggacggcgggcgcatcgactggcggatggtggacggggagctgcgggtacaccgggagttcctggagtccctgcgcatctacccgaaggaggcaccggggcttgtccacgaggcggtggacaacgcggagcgggatgccgtgctggcccggatggagcgggaaggctccctcaccgcccgcattaccctgaaggcggatatccgggcgctggtgcctgttgcgggccaggaggtgcaggcgtggctgcccctcccggcggcctgcccccagcagagcaatattgagctgctggactgcacccccggcggggtggccgcgccggagtatgcaccacagcgcaccatgtggtggaaaacaaacggcgtgggggagttctccgtcacctaccgttacctcttccgggcggagtacacggctcccatgtccctctctctggagctggcgcagccggactttgacctggaggagcagccgccccacatcgtctttaccccctacctgcgggcgctggcggcccggctgaccgaggggtgcgccaacccggcggaaaaggcgaaggccatctacgactacgtcaccggacaggtggactaccgctatcagcccgcctacctccagctggactgcatcgccgaccagtgcgccaagaccctccggggggactgcggggtgttcgccctgctcttcatcaccctgtgccgtatcgcgggcatccccgcccggtggcagagcgggctggccgtccggcccggccgggtgggcccccacgactgggccatgttctacctggccccccacggctggctgtgggcggactgctccttcggctcctccgcccgccgcagcggggaggacgcccgccgggcccactacttcggcagcctggacccctggcggatggtagccaattccgccttccaggcccccctgacgccccccatgcccgcctggcggcaagacccctacgacaaccagtgcggcgagctgatggtgggcggccgcgggctggacgcccccgagcgggcgtggggccacgagctgctggatttcaccctgctgtaacggaactatatgcaaaaagcgcctctggaatattccagaggcgctttgtatgtttgaaaaagtgtacgtttacaaatgaaatagtcgcactacctagtgtgaagtatagcacagaaatacggcgatatcaattacattttaacatagattttcctgcatttccaccattttaaaaggtacacttttccaaaagggggtggtttgccggccaatgctgtttcacctggccggagacccgcgcttcctgttttaagatgttttgtatgcagtccgaatggcatcctgcgggaacctccggtacggcggagtggtattgacacacattttctgcggccacgacccctgacatcaaaaaggaggaaaacagaatcatggagaaacgcatcttgtcggtgtgcctgacggcgtgcatgctgctgacgctgatgccgtccgcctttgcggcggacgtggagcagccccttcccatcgccggaatggaacagacggaggaaacaagcgcggacgccaggacggagcccggcgacgagccacaggagcccgtacccacagaggagggaaagggcacgcaggaggagcccttcactacggtagccgcctataatgaggcggtgaagggcgacgctctcgacggtaaggacgtatacctgactatcagcagaacggagtttaaggagggacagtttgccctgaccaatgtgcagacgcgccccaatccccccagactgcacctgaccctgacggactgtacctttaccggcaataccgccggagacaagacaaactcctcgtttatgtatttgcccaactgccagtctctggtgattaaaggctgcaccttcaacgccggagaggacggcctgaagtacggaatcaactggaacctctgcggcatccagggttccacggtggagatccggggctgtacctttacgggcagctatgagaagaatgccatcaagctgaaccagcgcaacggcgaggacgacgtggcaacagatgtgaagccgtcgggagacggagaagtaaaacccgccaccattgcctccgctgtggttgcggactgcaccttctccgagggggccaagattcaactgggttcccaggggaagggagagaacaatgccgccgcgccctccaccggcgcgttcccggtgaccatctccaatgtgaaggccgaaaatggcagcgaggttgcggttgagctggcctatcaggcggccaaggatgcggacatccccaccatcacgctggcccctggggacacctttgaaaagacgcaagaaggcgtccttgtggcacaggttggggaggagaaattcacctcttttgataatgctctgaccgccgcgctggccgcagaagatcacaccctcaccctgctgcaggatgtgacaaaagacatttccatcacagcgggcagcaccctcaccattgagggcagcggcaagaccctgtacggcaccatcaactgtgtggcagcttcgggcgaacatgccgaccagaccaacacgaacctcaccttgaacaatctgaccgtagacggcgacaccggcaggaatggaacggcggataaatccatcctcattacatctcagaatcagagcgcaactgttgtcagcggtctgaacctgaccatgaccaactgcaccgtgcaaaactccaaggcaggagtgagcggtggacagggcatgtatctgaccaacgcgaaaaacctgaccattgatgactgcacctttacgaactgcggcggcattaactatgccatcgacctgaacctggtcgccgtacaggatgccgtgatctcgatcaccaacactaggtttgaaggaaattgcggtgcttccggccccattaaagtcgctgaacgcggcacgggtgacgggactgaagccgatgatatcaccggcgcgcgggccagcgtcaagtccctgactatttccggttgtacttttaacaattcgaatccaattttgggcggcgatattgttcttggggtaacaacaaagacgggcgaaaaggacggaaatggtaccggctccttccctgttaccattgcggacaacaagactaccaaagaagacaagcagctaaagatcaaactggcctacacagatgactcggccaagaatattactacggatattggcagcgtggtggtaggcgatggaacaaaagaccccgcgcagggctttaccatcaccgccaccgccggcgaaggcggcaccattactcccagcggcagggtggccgtagccaatggcggcagtcagaccttcaccgtcgccgccgacagcggatattccatctctgatgtgaccgtcgatgacagcaccgccgcagacgtggtgcagaacgataacggcacctacaccgttcagaatgtgacaaaggactgcaccgtccatgcgacattctcgaaaaacagctcctccggcggctcctcctccagctccacccggtacacggtgagcgtggaggacacggacaacggcagcgtgaaggtaagccccacccgcgcctccagaggcaccaccgtgaccatcaccgtgaagcccgacgagggctatgagctggacaagctgaccgtcaccggcaaggatggcgattccatcaagctcaccgacaagggcgacggcaaatataccttcaaaatgcccgcttccaaggtggaggtcgaggcggtcttcaccgcgatcgaaaccgagccggaacagcccgaatccctgcccttcaccgacgtgagcagcggcgagtggtactatgatgcggtggcctatgtgtatgaaaagggcctcatggacggtaccagcgccgtcacctttgaccccggcgcggtgctgacccgcgccatgacggcgcaggtgctctggaacctggcgggcagtcctgccgcccccggcggggcgggcttcaccgacgtggcggcggacgcgtggtatgccggcgcggtgaactgggcggcggcccaggggattgtggccgggtatgacaccggggccttcggtccggaggacgcggtgacccgggagcaattagcggccatgctgtaccgctatgcgggcacactggagcccacaggcggcctggacggctttgccgacaaggacgcggccagcggttatgcggcggacgccctgtgctgggccgtgggcgagggtctgctgaccggaaaggacggcggtcggctcgaccccgccggcaccgccacccgcgccgaggtggccgtcatcctcatgcgctttgccgaaaagaagctctaatttaaagcagaaaggcccccggaacccatcaggttccgggggccttccaattatcaggactcttctgcgggcgcgccgggctctgcggcgggcgcggggggagcggcaggctcctccttgttcttgcccaggaagcggggcagctccatgcccgccatgtcgaacatctcgttcatgggcggaatggacttcatcaggccggagacaaagcccgccgtggcggtcttgccatccttctgctcgccgccgtcccagacggtgaccttgtcgatcttgatgcccttgacggcgtccacctggatgcgcatgagctcctccatcttgtcggccagcatcaggcgcacggcgtggtcggcgtcgccgcccgcggcggccacgatctgccgcaggccgtcggcctgcttgaccaggatctcctgggcgccctgggcctcggcctgcatcttggccaggatggcgtcggcctcgcccttggcgcggcggcggatctgctcggcctcggcctcggcctccagctcccggcggcgcttgtcaatctcggtcttgacgatgacgtcggcctcctgggtggccttctcacgctgggcgcgggcagcctcggccttctgctcggcggcgtaggcctcctccagggcctgggctgcggcgatcttctcggcggcggtggcgatgcgggtggcctcggcctccttctcgcggcgctgggcgttggacatggccacctccaccttggaggagttctcgccctggatggcggaggcgtcggcctgggccacctggatgcgctggtcgcggcgggcctgggcctcgccgatggagccgtcgcggtccttctcggccacgttcttctttgcgtcgttgatggccttggcggcggcctccttgcccagggcgtcaatgtagccggactcgtcggagatgtcggtgacgttgacgttgatgaggcgcaggccgatcttcttgagctcgccctccacgttgcgggagacggcctccaggaacttatcccggtcggtgttgatctcctcgatgtccatagtggcgatgaccaggcggagctggccgaagatgatgtccttggccagctcctggatctcctggagcttcaggcccagcaggcgctcggcggcgttctgcatgacccccggctcggtggagacgcccacggtgaagcggctggggacgttgatgcggatgttctggcgggacagggcgttttccagatccaccgagatggacatgggggtcagatccaggaactcataggactggatgaccggccagataaaggccgcgccgccgtggatgcacttggcactgcgggtggagccgtccttgttgctgcccaccttgccgtagatgaccatgaccttgtccgaggggcacttcttgtagcgcttgatcaggaacagcagcagggagaagacgatgacgacgatgacgcaggtaaggataagtccaaagatgtttggcataagttcctccttattctgtctcttttgattcggatgggatgggttccaccagcagggcgccgcggccggccagaccggtgacacggacagggctgccggtggggatgggggcgggggagtcggtgagggcctcaaattccgtcagctgctcctgcacggtgagggtgaccttgccgggggaggagcggccggggggaacggtgaggtacacggtgcccgtccgcccgagggcgttgcggagatccagggtgccgtcgtactggaggcgaagggcctggcggacggccagggcgatgcccaccatgccggcaaagccgatggggatggccaggaagaccgccaggaaaccgggcaggcctacctggtggagccacaggccgccccagccgaagagcaccaggaaggccaccacgccccgcacggtgaacaggtgcaggccggtgtcgggggtctccgggtccgccgcggcctcgtggagcgggccgccgtcggcgtcggggccgtcgaagtccggcccgtccgcgtccagcacaccggcgtcgccgtcgctgtcaaacgcgccccccgcaaagaggagaacggtctgaatcagcaggatcagcgtggcgggtacggcgatgtagagcagaacgtggtccagggcagagagggattgccaccaggctgccatgaatgggttcctcctttctcgaaatggggatgcgatctatcataaaacagcggtgggatactccgcgtccctaccgctgtcttgggacgcgtcaggccagggccgcgaggagggcctccgcctcctgcttgagccgtccggccagataggccgtcaggatcacatggaggcagcgggccacccggtcccgggcgcccgggacgctctcacggtagctctccgccgctgtctggcaccagcgggccgcctcgtccggcccgctgggaggctgatgctccaccagggccgccaggcgtacaatatagagatacaactggaaatcgtcaatcagatcgtccgattcatcgtccagctccccgttgacataggagagcagggcgcagattttgtccagctgcatggaatccttcagcatattgatcaggacgatgcgggaaaactggcggcgggagtaccgcttgcgctccggcggggccacaaagccccggcggacccagttctggatgacatagggctccagcccggtcaggctggccacctgggagagcatcagccccccggccaaaaagagggagttcagcagggtctccgcctcctccggtcggttccagtccaccgcgatggtggttcccggcagcgtctttgccatatcatccactccttttcttgctttgacatgattatactaaataatcatatgattgtcaatggggatttaaagataatttattaagaataaatgacgatttggtaacgctcaccagtccaggggcggggcataggggccgtcaatgaggtaatagggcagtccgcggcggcggcaggcctccagattgcgccggttttccgccaaaagtaattccatggtgcagaaggagtcgtccttccgccgctctatggcgttggcgtgggtctgaatggtgtcaaaccgggtgcggatgtacgcctcactgaacaccagacagagaaagcgtatgtgggggaggcaggacgcatcaaagtcctcccgccagttgaaggggatgtagcaaccctccaccgtcagcgactggccgttttccaccgcggttttgacgatctcccgcaccacgggccagaggacggcggtgagggcctcgtcggtgctctccggcgtcaggggacacatcccgctgcggatgaggcccatcttcaggtggtcgatggacagatagggcgcgccgtgccgctccagcaggcgctgggccagcagggtctttcccgtgtgcgtgctcccggtcagcagacggatcataaccattcctccttgctgttttttgtatcatacccccgcgcctgcgccggcgccagaggacggcggcggcgcgggaaaattcgccgcaaaatcgggaatgacctctttacaaggcggggagaatatgataaagtactacagcctgtaatttacaggcagaatttacccccggcttcgtccccaggctctcaccggccggtcacgcagcccagggcacattgtatgaaaggtggaacccaaccatgatccgtaaggacgagaagacggccgtgatcgaggccaaccgtacccacgccactgacaccggctcccccgaggtgcagatcgccattctgaccgcccgcatccaggagctgaccgagcacctgaaggtgcacatccacgacaaccacagccgccgcggcctgctcaagatggtcggtaagcgccgcaagatgctggactatctgatggccaaggacatcgagcgctaccgcgccattatcgccaagctcggcatccgaaagtaagaagaagcgcggaggcgtgcggagcaggacgacagcgaaacacgcagatgaaaaaacaggttggcggaacgccaacggcatttttcgcggagtgttgagcagttgtccgtcgtgcagccgccgcagcgtgacaacaacgaatcaagaggggtggcgcggactccgtgccaccccttcttcccatccgtcggagcttgctttttagcagttgaacctgggcccggaggaccggacccggcttcaagtgctaaaagggatcgggctctgatgtgtgggagacaccaatgaaaaggaggaatacccgcatgtcaaccattatcaagcacaaggaattcaccaaccacaaggtctacaagaccgaggtggcgggccgccccctgaccatcgacgtgggcaaggtggccgagctggccaccgcttccgccatggtcacctacggcgagaccaccgtgctggtggccgtcaccgtgtccccccgcccccgggacggcgtggacttcttccccctctccgtggactttgaggagaagctgtacgccgtgggccgcattcccggctccttcatgcgccgggagggccagccctctctgcccgccgtgctggcaagccgcgtgatcgaccgctccatccgccccctgttcccctacgacttccgcaacgacgtggtggtcaccgccaccgtcatgagcgtggaccgggactgctcccccgaggtgaccgccatgatcggcgtgtccgcctgcctggcctactcctgcatcccctgggccggccccatcggttgcctggaggtgggctatgtggacggccagattgtcctcaaccccaccaacgagcagaagcacgcctcccagctcgatctgaccgtggccgccaccgacaagaaggtgatcatgattgaggccggcgccaaggagctgcccgacgacatcatgtacgacgccatcgtggccgcccacgaggacatcaagaagcaggtggccttcatcaaccagatcgtggccgagatcggccgggacaagatgacctacgaccacgccgacttcgaccaggagctgttcgacaagatcgtggaggccaccatggatgaggcccgcgccgccatggacaccgacgacaagaacgtgcgcgaggagcggtggaacaagctcatcgagcactggcatgagctcttcctggaggactatcccgagatggacaagtacctggaggagatcacctacaagttccagaagaagatcgtcaaggcctggctgctggagggccaccgggtggacggccgcgccaagaacgagatccgtcccctggccgccgaggtgggcgtgctgccccgcgtccacggctccggcctgttcacccgcggccagacccaggtgctctccgtctgcaccctgaacaccctctccgccgcccagaagctggacaccatctgggaggaggaggagaagcggtatatgcaccactacaacttccccgcctactccaccggcgaggcccgggccgcccgctccaccaaccgccgcgagaagggccacggcgccctggccgagcgcgccctggagccggtgatcccctccgtggaggacttcccctacgccatccgcgtggtgagcgaggtgctctcctccaacggctccacctcccagggctccatctgcggctccaccctggccctgatggacgccggcgtgcccatctccgcccccgtggccggcatttcctgcggcctgatccaggacgacgacggcggcttcaccaccttcatcgacatccagggcgtggaggacttccacggcgagatggacttcaaggtggccggcaccaaggccggtatcaccgccatccagatggacatcaagaacgacggcctgtcccacgagatcatcaaggaggccctggagatcacccgcgacgcccgctatgccatcctggacgagatcatgctcccctgcatctccaagccccgccccgacgtggccgacaccgcccccaagatggtgaagatgaagatcgacgtggacaagatccgcgaggtcatcggctccggcggcaaggtgatccagaagatctgtgccgacaccggcgccaagatcgacatcgaggacgacggcaccatctacattgccggtaccgacaaggcctcctgcgacgccgccaagaagaccatcgagaccatcgtgttcgtgcccgaggtgggccagctctactacggcaaggtggtccgcatcctccagttcggcgccttcgtcgagctggcccccggcaaggacggcatggtgcacatctccaagctggccgaccgccgggtggagaaggtggaggacgtggtcaacatcggcgacatgatctgggtcaaggtcaccgatatcgacgagaagggccgcgtcaacctctcctaccgggacgccctgaaggagatcaaggccaagaaagaggccggcgagcctatcaagtaaagagcgcatacggcataaaaagggccggacggaaccattccgtccggcccttttgctctgcaagagcatagcaaacttgcccatgcgccgcttgcagcggcacggccataagatgacagcgcgtaggccggtacggcccacatgcgcgaacacttcatgcgcctaagcctttgcatagtttcgcggcgcgtcctgtacgcatggaggttcatgcaaatgatgcggctgcccgctcaggccagcaaaagctgaatgcccaggtcggcaatatagccctgccattcggctgagagctcgtcatccgtaacgatgatgtcaaaatcggagaggtaggcgaaagtcgtgggacagattttgctgaacttggaggagtccagcagcaggatcttggtctggctgctctccatcagggcgctcttggcgttcatctcatggggagccacacaggtgacgttcagcttgccactgatgccggcggtggagaggaaggccttgtttacacaggtgcggttaataaggctgataccctctggactataaaacatccgggtgttgggatagaggtagccgcccgcgcagatcacgtcgtagttcggatgcgtggtcaactgggccagggtgttcatgcagtaggtgagcacggtcaggtggacgccgctgggcagattttgtgtgaggtaggagcaggtggagccggtatcaatggcaatgacatcgttgggttcaatgagggaggcggcttttttgccgatgcgggccttccggtctccaaagtggagaacctcgtaatccagattgtactcgggaagggtactgtgggggttctgggcggcgcgatgaatggccacgccgttgatcagctttaccgtcccctgctgctcgagctgcttcagatcccggcggattgtaatttcagatacccccagctccaccgccagttcgcgaatcgatacgcccgtcttggcgatcaaaagctgggagattttatcaatacgtgtcatctttttgagactcatatggtgcaatcctcccatacttaattaaatactagggagagaatatcataaaaccggaactctggcaagaataaagcaaaaattagttggatattctgtacattttttgtaaagccaaattttaaaaaatgataattcaatgccttttatctctttcggagaagattattgataatatactatcaaataaagagattatatgaaattaaagcttaaaaagcagactgaaaactgtaattttgaacatttgttgacaagaaaaatgatatagaatacaatggagacaataaaaagcaaaataaatgaaaggagctgcgccatggaactgcgattggagcatctggtcaaggatttttccggaaccaaggcggtgaatgatgtcagcattacgattcaggacggcaagctgaccggattgctgggccccagcggctgcggaaagtccacgacactctacctcatctcagggctggagtcgcctacttccggaaggattttctttggagacagggatgtgacggccctgcccccagaaaagcggggcattggtctggtgtttcagaactatgccctctatccccatctgacggtggagcaaaacatcgccttccctctggtcaaccacaaggaggggaaggaggagatccgccgccgtaccctggagatggccagactggtgcagatcgaggatctcctcaagcgcaagccgggccagctctccggcggccagcagcagcgggtggccattgcacgggcgctggtcaagcggcctgatatcctcttgctggacgaacccctttccaatctggacgcccgcctgcgattggagatgcgggaagagattcgccgcatccagactgagacgggcgtcaccaccgtgttcgtcacccatgatcaagaggaggccatgagtatcacagatgagatcgtgctgatgaggaccggcgtggtgcagcagcagtgtccaccccaacagatgtatttgaatcccgccaaccgctttgtggcaggctttctggggaatccccccatcaatttctttcggttggacgtgtgcggcggaacggtgtgtctggcagaggactacatgctccgggtgcacggcgcggcggatgggccggtcctggtgggcatccggcctgaggcgtggcgtctggggcaggggcttcggactgcggctgaggctgtggagatgcggggcaaggatctgctggttaccttctcactggcaggggagcgggcccgcgccattctggacatcaccgccggtgtggcggcaggcgacgccgtggagctgaccctggagcctcgcctggtctatatctttgacccggagaccggcgcacggctggatgcggaggtggcgggatgaggagccccaagccggcccgcgcagaaaatccgctgggcaacacccggcgcagcgccaaggcatatctgtatctgctccctgcctttgcggttttggcggtctttgtggtctaccccatcctcatgacgcttcggatggggttttaccagagttacgtgtaccttaccgacaccggcacgggcttcggcctcaattcattccggtacgtgcttcaggatcccgctttcgggctggccgtgcgcaacaccatgtttattgttctggtgggcgtacctatcacgattgtgctctccctgggggcagccctgctcatcaattccctgcttcggaccaagggactgtttcagacactctattttctcccttatgtcacctccaccctggccatcggcctggtgttccgctggctcttccactcggaatacggctacatcaacttttttctggagtttttggggctggagccacagaagtggctgtccgatcccaacctgaccattgtggcggtgaccatttttaccatctggaacggtatggcgtttaagattgtcctgttcctggccggattgcaaaagatcgaccagcagtactacaaggccgcccggatcgacggcactccagcgcaccggatattcttccgcatcaccatgcccctgctctcccccacgttttggatggtcaccatcgtttcggtcattcatgcctttaagacctacaacgaggtctatgccatgttcagccgggagagcgctgggcctggaaacagcgccatcactatggtctactatatttatgacatgtttttcaaccggggacaggttcactacgcctcggcggcggccatcatctttctggccatcgtactggccctgacggtgattcagaagtgggtctccaagcggtttgtatactatgtataagggagggtcggatatgaaacagaacgtgggcaaggcggtcaagatcgccgttctgactgttggagcctttgtcatgatcttcccgtttttgtggatgctctttacctccctgaaaacactgccggagtccatctccatcccgccaaccctgttccctgcggtgccccagtttgaaaattacacggaggctcttgccgtcgccccctttggcctttatttgcgcaactccattattgtggcgggcggcggtaccctccttaccctggtgcttaccgtgctgtctgcctacggctttaccatttacgaatttcggggcaaaaagctgctgtttctgctttgcctgtccaccatgatgatccccgcagagctgctcatcatccagaacttcatcacgatctccaagctgggctggatggacacctttcagggcattattctgccaacggtggccagcggtttctatatctatatgatgcgggagtattttatgcagatcccctccatcctctacaaagcggccaaggtggacggctgcagcgactggcgctacctctggaaagtcatgatccccatgaacaagaatgccattgccaccattggaattctggcctttatcagccaatggaattcctttgtctggccccttatggtcaccaagagcgatgcccaccgggttatgcccatcggtctgctccacttccgggatgcggtgagctcccaggtaaatctgcagatggccggcgctacgatcgtcattgtacccatgctgattttcttcctggtcttccgaaagcagatcatcgccggcgtggcgcggggcggcatcaagggttaagatcctgcccggcctgccgggctttgaataacacaatgaaagcatatggcacgaaagaaaagaaggaggaattttcgatgaaacggaagctcatcagcgtaagccttgccctggccctgggcctttccctggcggcctgcggcagcaaaccggcccccagcggggccgaaacccccgccggggaactgggtaccctttccggccctgtggaactccagttctggcactccatctccaatcagaaccacctgaaggttttggaagggctggtggaggagttcaatgaaacgataggtgccgagaagggtattaccgtggtccccacctttaacggcagcagcagtgagctctattccagcgtggtgggcgcgatcaaggcgggcagcgcccctgatgtgaccctggccctgcgcccctatgtggccgactacctccagaccgactatgtggttaacctggagccctatattacagatcccaatgtgggcatgaccgactacgaggacatctttgaagggctgcgggaggcgaactccagctatgccaaggagggtatctattccctgccgatccactcctactccgaggtgctctattacaacaagacgttttttgccgagcacggactcagtgttcccaccacctgggacgagctggtggaaacctgccgcgccatccgagacattaccggcgcgcccgcctttggctgggacaacctggcaggcagctttatgaccctgctgctccaaaacggcggccgctacaccgaccagaacggcaatctgtactttgccaccgaggacagcgacattaccctgaaggtgcttcagatgtggcaggataacgtgaatgagggtatctggcgtactgcgggggaggatcagttcttctccgggccctttgccaatgagatgatccccatgtatatcggcgacagcgtggaggccagctatatcccagacaaaaatcccgagctggactggggaaccgcccctgttcctcaggtgagcgaggataccgccgccaacctgtccgccggccatgtcattatcgccttgaatcaggacggaaatcaggacagaatgtatgcggcctatgaatttatcaagtttatgacctcccatgacgccaacctggcggtagctgccggaaacaccggctatctgcccatacgccagtccgtggcggaggatccggcctatgaggcctatgtggccgacggccacgagtacatgcgggccggtgtagagcagagtgaccgctatttctatgagcccgtgtttaccaatgctaccaccacctccagcgccgtcaacagcgccgtcaagaccatgatgcaggaggtggccgacaacggcatggagccggagctggccctggccaacctgaagcagaccgtcggcgccaactgaagcggacttgggcagggcggagacggagcatccgcctccgccctgccgcggtcccgtgtcccggcccgggcgcgcagaaaggaaacctgacatgataccaattttttaccatgacatcgtaactcccagcggacacccgggggacgaggtcatatccgccctccagaaatttatccgccggggggagacggagctggcggtgcgggctgcctatgagctctacctgaccggggaggagctgaccgcctacctgtggagacggctgctggtgatcagtgccgaggacgtgggcctgggggagcccatggccccagtggtggtggacgcccttcaccgcagcagccgggagctctcccgggacagctccgattatcaactgctcttcgtccacgcggtgcgctatctgtgcgcctgccggaaggagcggggctccagcgtgcttgccagtgtggttaagcggcgcatacggcggggagacccctttcccctgcctgattatgtgtatgacatgcacacgctgaccggccaggagcgggggcggaacatcgaccacttcctggccgaggccgcctgtgtccggccgggggtccgggctacggcggaggagctggaggagaccgagcgctgggagcgggagctcgttgcgctgatgaaagaggaagaggcccaacaggaccgtacttaagaaaggaaggaccccatgacaaatcgcaccctagtggtctccattgatgcgctgatcacagcggatatccccgtgctgaagcagcttcccaacctggggcgcgtgatggagcatgcctcctggattacggatatcgaatgtatctatcccaccttaacctatccctgccatgctaccatcgccaccggctgctggccggaccggactggcatcaacaataatgagattccagatttttttgcaaagggacggatggactggtattggtggcgggaggccattcaggtgcctaccgtggtggattttgcaagacaggcggggctgactgcctctaccgtcacctggcccgtcatgtgcgcctcaggagcggagtacaatattggcgagatctgggccccccgggaggaggatgacccgacaccgtggtttaccagggccaacagccctgcggtggcgaagatttttgaggccaataagcacatgctccgctggatgaagacgccacagatggacgagttcgccgcaaagtgcgccgccgacattatccgggcccaccgccccgacctgatgctgctccacctgtcctacgttgaccaccagcgccaccgcctgggcgtgcacggagatctggagcacgccttccgctttattgacggacagatggggcttgtgctggatgcgctggaggagaccggcggcgtggagaacacaaatattgtgctgctgggcgaccacggtcagctctactgcgacgagatgttccatctgaacgccctattccaccggctgggctggctccagaccgcggaggacggttccctggcagactatcaggtttatgccgccaactgttcgctcagcgcacacatctatctccggccggaggtggaccgggaaatggtgtattgcgtcctgctggagcaacagaagaagtaccccaaatacctggagcggatctttaccaaagaggaggccgcgcagatgcacctgaccggcgattttgactttgtcattgaagccggcgaccgggtgtgctttggaagggccctggatggggagcagcttatcaccagtgtcaacgacataaaggaatacaagccatcggtctccacccacggccacctgccctggaagggggacaagccccccttcatcgttgccgggcccaatgctgtatccggcaggataatccacggcgggaggctcattgaccacgcgcccaccatcctccgtctgctggggctggaacccataggaatggacgggcatccggtggatgccctggtgcggccctgatgggaagagggttacaggctgccccggggcttgtctgttttgatctggacggcacgctctaccacgacgaccgtatctacctgcgaatgatcgactactactttgccggtactccatgggagaaggagaccgggtctgtaaaggcggagatgagccgggtgctggcgggaggcaatccggccttccgctgcggccggtttgcccccaaggaatggggggtgtgtcctggcccggccaccgcgctgctggctgtgcccaccgaggctgcactcctgcgtccggacccctcgccctggctggaccggagatgctggtcctatatctccgacggctggagcctggccatgtacctggcccggcgtatcggctgggacggtgaggcgttctgggagcggttccagttggcccggcgggatctgctgaccgacggggtgggcccccaaccggatccggtgctggccgggcggcttctccgcctgcgggaccgcggcatccggcttgtgctgtgctcaaattccaggcgggagggaggagaggcgcttctggcccggctggggctgctggggtgctttgacgagcagatttttgacgcggagaagccccacgccactccgaaacgtatggaagggtggagcgcccgctgggggataccatctgacgcgatgctgtttgtgggggaccagggatacggcgacctgtacgccggcctgcgggccggagcgcgcaccctgcgggtttctccatacccagcggatgatgagggcctttgggatgcctgtatccgcacgcaggaggagctgaaggagctgctggctgcctggtgctgaagccgggcagtccagcccggcgggaggacattctgcatacaggccggacggaggagagcccccgcccggcctgctgtttttcccgcggattttccggctgacaagtgggacggaatgtgatatagtgttgtaacccaaacgagaacaggaaaggagagcgcggccatgaaaaagaaggtggtgggctacctggcgctgatcctggccatcacggcggtggtactgctcctgattgccctgcgcggggcgtaaacggcacggtatttgtccatactaagcgcgaaaatatagagaagtgcgaggttacaatggtttgatgtatgaaaaaaagacgctccccaacggggtgcgtatcctgacggaacatgtgccgggggtgcgctcggtttccctgggcatctgggtggggaccggctcccgccatgagagcgcgggggagaacggggcggcccatttcatcgagcacatgctcttcaagggaacccggagccgcaccgccgcccagttggcggaggagatggacgccgtgggcggccagatcaacgccttcaccaccaaggagtgcacctgcttctatgcccgggtgctggacacccacctaggccgggcggcggacatcctgtgcgacatgttcttccactcccggttcgacgacgccgacgtggagaccgagcggggggtgatcctggaggagatcggcatgtacgaggacaacccggaggatctctgcgccgagcggctggccggggcggtattcaagggctcccccctggcccggcccatcctgggacgaaaggccacactggacaagatggacggggcgtggctgcgggcgtaccagcgcgcccactaccggcccgaccgcatcgtggtggccctggcgggcagctttaccgacgccgacgccgcggagctggccgggcgctttgccggcctggaggcgcggccccacaccgctgcgagggccgccgcctatgtgcccggggtggtggtgaagaagaaggccatcgagcagaaccacctgaccctggctttccccggcctgtccttcgccgacccccggcggttccagctccagctcctgtcctccatcctggggggcggcatgtcctcccgcctgttccagcaggtgcgggagcagaaggggctttgctactccatctactcctacggcacctgccacgacgataccggctacttcggcgtctacaccgccctggggcgggagaccgagggacaggcgctggacaccattttggccgtggtccgggagctgaccgagcacggcgtcacccaggccgagctcgaccgggcccgggagcagtccaaggccaacgtgctcatggggctggagtccacccagtcccacatgagcagcttgggccggggcgagctgctccagggcgaggtgctggacgaggacgccatcatcgctgcctacgacgcggtgacgcgggcggacgtgcaggccctggccggagagctcttccggtttgaaaacgcctccctctccgctgtggggcgggtggggagcgccgacgcctaccgggcgctgctgcactgaaatcaagctcaaaacggaggacggcctttgatatgtacccagaattctggacacataaaaaattgaattaggtgcacatggatgcctctctgaattttgtaggaggcatccattttgttttctcttggattctttcgttgttgtagtaatttatgtagccgtcaacagccttggcaaatgtttcaaaagaggaatactctttttcatgcccgtagaacatctcgtttttcatccgtccaaagaaggtctccatgatgcaattgtcgtaacagttgcccttccttgacatggattgaatgattttgtgatctttaagtgcctgcctgaagtacacgtgctggtactgccacccttgatcagagtgaaagatcaggccatctacagagggaaacttcgtaaaggcgccggccaacattctctggatctgttccatattggcactttgagataaatcataagaaatgatttcgtttgtgttcatgtcgagtataggagagagataacacttcccccacgaaaaaccgaactgagatacatcggtagtccatttttgcataggagctgtcgtgctgaaatcccggtcaaggatattctcagcaaccttgccgacctcgcccttgtaggaatgatacttttcctttgggcgctttcctgccaaccccatagtgtgcataagccgttgtacccgcttatgattgaccttgtggccgcgctttatcagttcctgatatactcttcgcacaccgtagcggcctttatgctgtgagaaaatgtctttgatttcatctgccaagcaatggtttcgaacagcaacttgatcggccttgctcaactcaaaataataggtagaccgtgccatctgcatagatttcaacagatatttcaattggtatcctttttcacgcagctctttgatgatcgctgctttctcgccttgagttgcgctgcgtgcctctcttctctcaaggcgatctctttttttataacttcattctccgcctttatatactcgttttctgcccgaagccggatcaattcttctcgttcggattcattcagtggccttgcttcttcctttttcatttggggtacccctttacttggacgaccttttttcatttctaccaggccattatacccctttgttttatagttttgaacccattgatacaatagtctatcttgaataccggcctcgattgccactgacacacaggattttccggacattacttgggatactagttccagccgttcttctggtgtccagttcctgttgaaatttttgtgtttcagtgcttctggaccgcggctatcctctgctcttacccatagtctcactttatcccgaaaggatttatcgctaacaccttccggcgtttctggccattttccttctcgatacagttctacacatttccttttgtactcatatgtgtaccgcataataataccccctctactgggtgtccagtaaagggggtacatatcaccttttgccgccctccgtttttgcacgccttgggaagagaaagggcggatttaaattgaagtttccacaaaaccgtgataggatgtggaaaacaggagggaaaaccaacgggggttcacgggaggaggatggcgatatggagaagaggagatggagaacacggctgatcgttgtggcggttctggcggtcctggtgctggtgttcggccccaagaagctgggctggctggttccggggccggatgaggcggtaacgggctatgtcatgtatgaactcttttccggcagcggggcccatgaccccgccggggaggggctggaggagctgcgcaccgttctggacgatacctgggtgctctggtggggggtctccaactcaatccccatgaaggacagggaggaccaccccttctggctggagatttacacagaggagcggattcctgcggccaccttctgcctgggttccgacgggctgcggtatgagggaaagctgcgcttccgcccgctgaacgccgacctgctggcggcgctggagccgttggcggagcaatgggaacaggaacacaaaaatggaggagacgggtgaatgatatgtaccccctttactggacacccagtagagggggtattattatgcggtacacatatgagtacaaaaggaaatgtgtagaactgtatcgagaaggaaaatggccagaaacgccggaaggtgttagcgataaatcctttcgggataaagtgagactatgggtaagagcagaggatagccgcggtccagaagcactgaaacacaaaaatttcaacaggaactggacaccagaagaacggctggaactagtatcccaagtaatgtccggaaaatcctgtgtgtcagtggcaatcgaggccggtattcaagatagactattgtatcaatgggttcaaaactataaaacaaaggggtataatggcctggtagaaatgaaaaaaggtcgtccaagtaaaggggtaccccaaatgaaaaaggaagaagcaaggccactgaatgaatccgaacgagaagaattgatccggcttcgggcagaaaacgagtatataaaggcggagaatgaagttataaaaaaagagatcgccttgagagaagagaggcacgcagcgcaactcaaggcgagaaagcagcgatcatcaaagagctgcgtgaaaaaggataccaattgaaatatctgttgaaatctatgcagatggcacggtctacctattattttgagttgagcaaggccgatcaagttgctgttcgaaaccattgcttggcagatgaaatcaaagacattttctcacagcataaaggccgctacggtgtgcgaagagtatatcaggaactgataaagcgcggccacaaggtcaatcataagcgggtacaacggcttatgcacactatggggttggcaggaaagcgcccaaaggaaaagtatcattcctacaagggcgaggtcggcaaggttgctgagaatatccttgaccgggatttcagcacgacagctcctatgcaaaaatggactaccgatgtatctcagttcggtttttcgtgggggaagtgttatctctctcctatactcgacatgaacacaaacgaaatcatttcttatgatttatctcaaagtgccaatatggaacagatccagagaatgttggccggcgcctttacgaagtttccctctgtagatggcctgatctttcactctgatcaagggtggcagtaccagcacgtgtacttcaggcaggcacttaaagatcacaaaatcattcaatccatgtcaaggaagggcaactgttacgacaattgcatcatggagaccttctttggacggatgaaaaacgagatgttctacgggcatgaaaaagagtattcctcttttgaaacatttgccaaggctgttgacggctacataaattactacaacaacgaaagaatccaagagaaaacaaaatggatgcctcctacaaaattcagagaggcatccatgtgcacctaattcaattttttatgtgtccagaattctgggtacatatcagaaccgtctcctccgtttgcaatcgttttatccaatctttggatagcctacggattcatccagacggtattggagcgccgaccaggtgatgtccaccgtctcgtccgggttgtgattgagtttcagcaggtgcgggagcagaaggggctttgctactccatctactcttacggcacctgccatgacaataccggctacttcggcgtctacaccgccctggggcgggagaccgagggacaggcgctggacaccattttggccgtgatccgggagccgaccgagcacggcgtcacccaggccgagttggaccgggcccgggagcagtccaaggccaacgtgctcatggggctggagtccgcccagtcccacatgagcagcctgggccggggcgaggtgctggacgaggacgccatcatcgccgcccgccccgcgctttggggcgggcggcttttctgttcccaccctgccttcccctgggggaaggtgccccggaggggcggatgaggggagaactggcaatcttaaaccaaacttaagggaaatgtaaggaagtttttgtgcggttatactacgatggcaatgcgggagaggaggttccagagattccccctcagacggcttcttatcggacttgcagagaatatgcgtggttttccttgtaacacaaaacacaaagaggcctcagcctgcgcgtagagggaggatttagccggcaaacgtcaaccgaggcattcaatgaaagaaggggaaaatatgaaattaatcaaaagaattactgcatatctattgacctttagcattttattgagcatcggttcgtctgtagtggctgccgcagtggcgcctgtcgagcaggaatatccagcgcatgaagacccgtcacaggaaatgttaactgatctggagcaaaagggggtacaaattaatcacgttaaagattcgagcctaataacaaatatcaaaaatcctagtaacgggaaactctcatttactattaagattccagcaaaccaaacactgtactataaggtagagttaattcctagcaaacgggcaggcgctattgaaacacctaaaaatgcatcttattacaatagctctaataggacagttacaaagacaatcactgtggatgtaaagcatttctctcctaactatgttataacagcaaactatacaacaggtaattccagaattaaaacggtctatgaagatgaggaaaaagtagctagtaagttggtaaaacaaattacctcgaaaccatttgtttggactcaggcggaacttgataaatataatgcgggtaagacaattagttgggctgtgacatttgccacattagaatttgtatcaattgaaataggggccctattgaaaggagctgaaacgattgggactgcacttaatattgggtggtcgtttattggagatggaggagtgccctctacagaaagtcctacccaatatgaacttgatatggtacctagactaggactaaaatatcaagtaagctatattcctacaaatagtggaataagcagaaagatattagttactttgccagatggacgtagctcaacatacagtttaggtacctatccaagcggcatcacaattaggatcccgacttgaggaatttggccaatgaaacacagaaatccaaagaagctggcacagaggattgtcggaatcatcctattgaccggcggcaatctgatagctacgacgctgtacctcccggaattccgctacgtaccggagctgtttgagcgattgcagatgtatcgtgcaatcgcacttgtgcttggtattacaggtgccattatctttgcgagatcttttaaaacaaaataagttgcttcggaggcaataatcaggcagaggagtgttgacactcctctgcctgattttatagcgtctgttttctcaacagccggatatcctccccatagaaggggagcacgcggtactctccctccaggcgggaggcgatctggggggtataacgggcgcgcacctgatccatggtcaggttggaggagatcaccgtccgcttgtccgccgtcaggcgggtgttgatgagggtgtagagggcggactggacaaagggggtggaaagctcgctgcccagatcgtccagaatcagcagatcgcagcccaggtagcggcgggtctcgtccttggcctccccagcctccagccggtcccgggcgaacttctgctcctcgaagcgggtgaagatgtttaccgccgtgtcgtacaccacggagaagccgctctccgacacggtgcgggcgatgcaggccgagaggaaggtcttgcccagccccggcgcgccggtgaggaacaggttgcggaagtagaaccggccgaacttccgggcatagctggagcacacgtcgaagataaactccatgttctcccggggggagagggactcccccggccagggcaggggggagtagtagtccagggagaaggagtcaaaggactgctcccccagatccagcagcttggacagctccctgatctgctcctcggtgcacagcgccttaaggcaggcgcacatattggcccccacccagccggtgtcgctgcacttggggcaggcgggcttgtcgtccagggcgtcggcgggatagccgtgctcggtcagcagcgccgccttctccgcctgtaggctcaggtttttatcccggattacaccgatggcgggcaccggatcgctgccgtcccgcagggaggcggcgatgatctgggtgatggtgcgccgcagttcccggtcgatggccgccacccggggcagcttggcgtaaatctcggagcgcaggcgctcctgcgcctcctcccgggccttccgctgggcctccagccgggcggtggcccggcgcaggacgctctgctcgtatcccatggcttactctccctccgtctcctgctggcggcgcaggaactcccgcatccgctccaaatcctcccgcacccgctggtcggcctcgccgggggcggcggggcggccctgcatggcgggctgggccgccgggcggcgctgccggtcgcccgcctccacctccgccagggtgtgcaggttcttccggtgccagccgcacagaatgccgttcatgtagtcccagtccatcttctgcttcttgtagaccgtcttttcgtaggccaggcggagcacctcgtcggcaaagcccatgtccgtccaggccgccaccttcttccgctccttctccaccagggggcggggcggctgatccagcaggcggagaatctccccctcccggctgcggtagagggcctgcttcttcaggtgggcctcggcggcctgggccgtgtccacccccagccgccgccacacgaagccctccttctgaatctggctcatgcggggcttgcggccggggccgtacttccgctgaaactcctccacgcaccagctcaccagcaggcagatcacctccgccggcagggccaggtagtcgtagagggtgtacaggctcttcaagtccgacgtggacaggatcttgcccagacgccgctgcacctcgttcaccaggccggggaaggaggaggcgccgtcctccagctcccgcgtgatgtcggcggcggtgtactccggcgggccctccggctccatccgggcgggggcctccggcgcggccgtgccgtccgccaggcccagcccgaccagggcggacagggccgcctccagccggggcacgtcccacttcagcgcccggcgggccgcctccggctccagccgtccgccccggcgcagcaaccacaggtacagcagcgctgcgtccccgtttcccgcgcccatcagccggtcggccgcccgggccgtcatggatagaatgtcaccgggcagcagcagctcggccatgtgaatcccccgttcctctctggtttcccgcctattatagcataaaactacgcgcggtgtatactgtggatatcggccccctgcgtggcgtgcggcgtaggggcaagcggggccgcggccatatgggaagggagaaaatgcaggctgggtgcccacacccgcccgcgggcggccacaagggccgcccctacacagaagcgcggagcgcccgggagcagggaaacagcgagacccgcaggcgaaaaagcagttgcgccgcaggcgcaaggtgttttttgcggagggacgagcagttgcccgtcgcggagggcgcgcagcgtgacaacacagaagcgcggagccgtcgtgagccgcggcacagtgagccgcgcaggccggaaaacaggccggccgaagcccggcggcatttccggcggagcggggaatagtgaccgcgtcgcgaacaggcagagcgtgacagaaagcgcggagccgtcgtgagccgcggcacagtgagccgcgcaggccggaaaacaggccggccgaagcccggcggcatttccggcggagcggggaatagtgaccgcgtcgcgaacaggcagagcgtgacagaaagcgcggagccgtcgtgagcagcggcacaggttgccgtccgggcgggaaaatgaaaattcatgaagatttcatttctcatccgggcggaactatggtataatagccgcaaagcggctattacacttgcatttcagccgtttttcccgccccttgcggggcaaccgaaaaacagagcgcattataccattccgctgatgcttcctggtataatgtccgaatcctaaatcactatggtcaggaggggtttccatgaaaaaccgtgtcaccgtcaccatcgccggacaggagtatacgctggtgggcaccgaggaggcgagctacaccgagaaggtggccgcccacgtggacgccaaggtggaggaggttttgagcggagcccatgtgtccctggtggatggggccatcctggcggcggtcaacattgccgacgagtacttcaaggaggtggaggccgccgagaatctgcgccgccagctcaaggagtacctggaggaggccaccaagatgaagctggagctgtccgaggccaagcgggagatcttcaagctgcagaacaagaagtaagagagcggagcgggcggctttggccgcccccgccagggaggattccgtctatgctggaattgctcgcccccgccgggtccatggaggccgtggcggcggctgttcagaacggcaccgacgccgtctatctgggatacggggactttaacgcccgccgcaacgcgaaaaatttctcggaggaggagtttgcggcggcggtttcttattgccacctgcggggggcaaaggtctacctgaccctcaacaccctgctcaccgaccgggagctgcccaaggcggcggaggtggccgcccaggccagcgccatcggcgccgacgcggtgctcattcaggatctgggcgtgctgcggatgctccgccaggttgcccccgatctgcccgtccacgcctccacacagatgaccctccacaacctggacggggtgaagatggccgccgatctgggcctcacccgggcggtgctctcccgggagctgagccgggatcagattgaatacatctgccagcgcgcccccatcgaaatcgaggtcttcgcccacggggccctgtgcatgtgctactcgggacagtgctttctctcctccgtcatcggcgggcgcagcggcaaccggggcctgtgcgcccagccctgccgcctcaagtacggctggatggacaaggccgacgcctaccccctctccctcaaggatctgtccctggcgggacacctgcgggagctgcgcaggatgggggtggcctgcgtcaagctggagggccgcatgaagcggccggagtacgtggccgtggtcaccggcatctacgcccgggccatcaaggaggatcgggagccgacggaggaggagctggagcagctccgggccgccttctcccgccagggcttcacccagggctactacctggatcagcaggggccggacatgttcggcgtgcgggaggagaccagagagccgaaggagctcttcgccgccgcccgcaatacctatcagagcggggaggcccagcgggtgcccgtcaccttctacgccatgctccgccccggcgagcccgcccgcgtgggggtggaggatccggacggccgggtggcgacggtggagggcccggtgcccgaggccgcccgcacccgccccctgacggcggaggcggtcaccacccagctctcccgcaccggcggcaccccctaccgctgcgggcaggtgcgcgccctggtggaggagaacctgtccctccccctggccgccctcaacgccctgcggcgggaggccctggagaagctctccgtccagaggcaggagccgccccgccgccgcgccggggagtaccacgccggcgcccgctatgagaaccggcgggaggagccggtgctgaccatctccgtgcggagggcggaacagctcaccgacgagctgctccgcctcaggcccgccctggtgtacgtcccgctggacgagctggccgcccacctggagaaggccgtcggcacggagcacacctccatcggggtgagcctgccccgggtggcctgggaccgggagtaccccggcctgcgggaaaagctggagcaggtgcgcgctttgggggtaaaagacgccctgctgggcaaccttggtatgttccccatcgcccgggagctgggcttcaccctgcggggggacttcggcctggagatctacaacgcccaggccctcaaggagtacaagcggctgggcctccagtcggccaccctctcctttgagctgaagctggcccagatccgcgacctctccaaatgcctggacaccgagctgatcacttacggccgcctgcccctgatgctgatggagaactgcatcatcagaaaccgcaccggctcctgcggctgccagaacaccaatatcctcaccgaccggaagggcgcccgcttcccggtggtgagcgcccccggctgccgcaacgagctgctcaactcccagaagctcttcctagcggacagggccgccgactaccgccgcatcggcctgtgggcccagcggctgctctttaccaccgaaaatccccgggagtgcgtgcaggtggcccagcgctatctggagcaggggagctggacccccaacgagtacacccgcgggctatactatcgagatgtggagtgaaccccatgaagctgaagatcaaggccgtatcggacaagatcggcaaggacatcccctaccccttctacgccaccgccggcgcggcggccatggatctgtgcgcctgcgtggacgcgccggtggaggtggccccccgcgccctggtgagtatccccaccggcatcgccatcgccctgccctcggcggagtatgtggccctggtgttcgcccgctccggcctgggcatcaagcacggaattgccctctccaacggggtgggcgtcattgacagcgactaccggggggagatccgggtggggctgaccaacctgtccgacaccccctacaccgtccagcccggcgaccgcatcgcccagctggccgtcatgcccgtggtgcaggccgagctggagcgggtggacagcctggacgataccgggcgggggaccggcggcttcggctccaccggaaagtaagggcagacgcagcagaccggtgcgggccgccgggacgtgtaggggcggggctcgtccccgcccgcgggcggccacaagggccgcccctacagggcagacacagcgaaccgatgcaggccgcctggatgtgtaggggcgggcgcccacacccgcccgcgaaagagcatggaaccgggcggagcgccgcggctgccgcgcccctccggccaattaggaaaggaacagaagtatggagatcattctggcctcccagtcgccccggcggcgggagcttttggagcgcatggggataaagaactttcgcatcgtcacccccgatattgacgagcacatggagcgggagctgcccccggaggagctggtgcgccgcatctcggcggagaaggcccgggccgtgcgggagcaggcgggcatggatgcggtggtgatcgccgccgatacggtggtggctctggacggggcggtgctgggcaagcccgcggatgagctggaggctttcaagatgctctccaccctctccggctgccgccaccaggtctataccggccttaccgtcctgcggggggaggagcggcacaccgtcagcgaggagaccaccgtcgccttccgggagctgagcgaggaggagatctcctgctacatccagaccggagagcccatggacaaggcgggggcttacggcatccagggctttggggctctgctcattgaaggcatccagggggattactacaatgtcatgggcctgcccgtgtgccgcctgggcggcatcctgcgccagctcggcgtggactgcctgcgcctggcggcgggcgagcgggacagcgactgagagagagggaacggacagacgtgaaggattttttccggcacaacggaatcctgattttaatcgcagccattctgctggccctggtgacggcggtggtgtcgatgctgttcggcggtgtggccgaccccctgtccaacctggtggggatccttaccacgccggtgcgcaacggcattaccgcagtgaccaactgggcggaggagaagtacaacgatgctttcgagctggagcagatgaaggaggagctggccgggctgaaacagcgcaacgccgagctggaggcccaggcccgggaggcggaggccgccctccaggagaacgagcgcctgcgcaacctgctggagctccagcccaaggagtggtcctgcgacaaggccgccgccatggtcaccgcccgctccacctccaactgggagtccaccctcaccattggcaagggcagcgctgcggggattgccgtggatgactgcgtggtggacgagtactggaacctggtgggcgtggtggcggaggtgggggagaactgggccaccgtgcgtaccctcgttgactcggacaccgagatgggcggccagctcgcccgaaccggcggcgcggccatcctggagggagactttgccctcatgggggagggcaggctcaagctgacttatctgccggagaacagcgagctcatcgccggggatctggtgaccacctccggccggggcggggtataccccgccggactggtggccgggcacgtggaggaggtgcgcaccgatgcctccggcatgacccgctacgccgtcattgcgccggagaccgatctggacggcctccagcaggtctttgtgatcaccgactttaccgttaacgaataaatgggacgtggccggaaaggggggaagcgccggtgaccagacaggattttctcattaaatggggcgtatacgccctggctctggtgcccgtatggttcctggagctgtttgtgctcaaccgctttcccctctttggggtggcccctatgctcctgcccctggctgccgtgtgcgtggcggtgctggagggcaccacggcgggggcgggcttcggcctgttcgtgggcatcctgtgcgacgcggcctacttcaacaccgacggagccatgacggtggggctgtgcctcatcggcgtgggggccggcgccctggcccagtatgtgctgcgccagaacctggtgggctgcctgctgtgctccttcgcggcgctggcgctcatcgacggggtgcgcatcgccgcccgcctgctggccgggcggggggagctggctgccatgctcggcttggccggacgggagattctctggtccctggtctttgtgttcccggtgtacgccctgttcctgtgggtgttccgccgggtgccgaaaaaaaccgtgctgtaaagacaggccgccccgccaccgaacgcggggtggcctcatagactgaaaaagggggcccgccatggagggcagacaattcaaccgccgcaccctcgccatcctggtggtgcttacggcactgctgctgctgttttttggggtgctctacaacctgcaggtgctccatgtggacgactaccgggcccagagcgtggtcaagattgccaaccggaagacggtggaggccgcccgtggggagctgctggaccgctacggccggagcatggtgaccaaccgtgccacctaccagctcacgctgaataccggtgtgatgggggaggaggcggtgcgcaacgccaacctgctggagctgctcaacatctgccgggacaacggcctgacctggaccgacaccctggccgtctcaacggcagcccccttcacctacaccagcgacacccctctggcctacgagaaggaggggggcggcgtggccctgacccggctgggacggctgctcaacgccctccctatgaaaaaggagctgaaaagcagcctgaacctgcccgccaccgagcaggtagaggccgccaagaccctggacgatatccccgccggtcccacggcggaggagctgatcgccgccctgcgcacctactttgagattgacccgtcctggtcggacgccgatgcccgggccctgatcggtgtgctctacgagaccaatctgcgcacctacagcatcaaccagcaggcgtacatctttgcccaggatgtgaatattgatgtcatctctgcggtgaaagagcgccggcttaccggcgttaccatcgaaaccaccaccgtccgtcagtacaacactgtagccgcagcccacctgctgggccatgtgggagacatccagtccagcaactgggactactaccgggagcagggctacagcatgaacgacaaggtgggcatcgacggggcggagaacgcctttgaggagtatctgcgtggggagtcaggggttcagatccaggagctgtccaccagcggaaaggtggtcagcgagtactggcgcatcgaccccgagaccggagaggagcagatccccaagccgggggacaacgttctgctcactctggacctccgcctccaggagaaggtggaggagattctggccaacaccatcgagactctggagtcggaggataccgggggcggcgcggtggtggtggagagcgtcaagacgggggagatcctgaccatggcctcctatcccacctacgatctgtccaggatctacagtgatatcaccctttacaatcaactggccagcgacaccgagctgaccccgctgctcaaccgagccacccaggagttttactatcccggttccaccttcaagccgctggtggccatcgccgcgctggaggagggactgaccacgcccacggagaaaattcaggacaccggccgcctccagctccccgaggaggagcactacccctacggcgatttccatccccagtgctggatctaccgccagtacggaggcaaccacgggtgggaggatctggccgacgccctgcgggactcctgcaacatctacttttacaccatgggccaccggctgggcattgacaagattgacgagtacgcttccctgttcggcctgggagagtacactggtatcgaactgcccgaggtgaagggctatgtggccggaccggccaccagcgaggccctgggggtggagtggtacggcggcaacctgctcaacgccgccatcggtcaggacaacacccaggttaccccccttcagctggccaactatatcgttaccctgctcaacggcggcgatcacttcgtgcctcacctgctcaagtccgtcaagtccagcgactactcggagacggtgtatgagcagcagcccgaggtgaaaaaccacattgctctcgaccccgccaacgtggaggcggtgaagcggggcatgtgggaggtggccaacgaccccaagagcaccgtagaccagtacctgagcaacctggcggtggaggtgggcgccaagaccggctccgcccaggtgggctcggcggacaaggaggccgacgccgtcttcaccctgttcgccccttatgacgacccggagatcgtcatctccatcgtggtggagggcggtgcctcgggcggaaatctggcccaggccgccggcgagattgtcaactactatttcagcgcggagcatacggtggaatcggtggacgccgagaacaccctgctccgctgaagggagccgttccttgtgtgtgatccccagacctttgacagccgggacagccggtataagcgcccctatggcgccgtaccctccggcacccgggtagagctggccctccgcccgccccgggccgggggattttctgccgccacactcatcgcctactttgagcaccgggacgaggagcgccgggagctgcccatgccctggcggggcctggagggggaccgggatgtgtttgccgtaaccttggagaccggggactatgtgggcctggtgtggtactccttccgcctggagggcctggacggccgcagggaggagctggggcccttccagctcacggtatacgacggggcggaggaggtgcccgcctggttcggagagggcgtcacctatcagatcttccctgaccgcttccgccgcacccgggttcccgatcccaccggcatggtgggagggcgcagcgtccacaccggctgggaggaggagccggtctaccgccccgaccggaacggtgaggtgcgcaaccgggacttcttcggcggcgatctggccggcgtgcgggagaagctgggctacctgcggggcctgggggtggataccctctacttctgccccatcttcgaggccccggagaaccaccgctacggcaccggggactatgagaagatcgaccccatgctgggcaccgaggccgacttccgcgccctgtgcaccgacgcccacgccctgggcatgcgggtggtgctggacggcgtgttcaaccaccagggctttgtcagccgctatttcaacggcgacggctcctatgagagcgtaggggccgtccagtcccaggacagcccttattacccctggtaccacttctcacactggccggacaaatacgactcctggtggggcatctactccctccccgccgtcaacgaggccgattcctcctaccgccggtatatcttcggcggcgcggacagcatcatccgccgctggctggccgccggggcggacggctggcggctggacgtggccgacgagctgcccgacgactttatccacggcatccacgccgccgcccggcaggccaagccggaggcggtaatcatcggcgaggtgtgggaggacggctccaacaagatcgcctacggcgtgcgccgccggcacatcctggggggacactgcgacgggctgatgaactaccccttccgaaacgccctgctctccttcctgctgggcgaggacgccttccgcttccggcaggccatggagaccctgcgggagaactacccgcccttcgcctggcgctcggccatgaacttcctgggcacccacgacaccccccgcatcctcaccctgctgggcacggggggcgacggcaaggaccacgacaaggactggcgggccgccttccgcatgtcctccggccagtacgccctgggtaaggcccggctgaagctgggggccctggtgattttcgccttccccggctcccccatggtctattacggagacgaggcggggatggagggctttgaagaccccttcaaccgccgcacctacccctggggaagggaggacggcgagctgctggaatggtacaccgccctggggaaggcccgccgggcgctgcccgccctgcgccggggggagctggcctggacgctcacccggggacgggtactctctttcctccgcactggggccgaggggagcgtattggccgccgtcaacgccggcgaacggccggagcccattgatctgccctggcccgcccgggactggatgaccggggcggccctggaacagggggagcagacgctccctcccatgacaggctggctgctgacgccccggccggaaggagcgtgaactgtggagcagcccctcatcagcattattgtgccggtctacaacgcggagccctatctggacaactgcctggactccatcgccgcccagacgtgggggaacctggaggtgtggctggtggatgacggctccaccgacgccagccccgctctctgtgacgcccgggccgccgccgactcccgctttcacgtgctccaccaggccaacgccggggtatccgccgcccgcaatgccgctctggagcgggctacggggcagtacctccagtttgtggacggggacgactacctgccctccaccgctaccgagcggctggtccgcaccgccggggccaccggggccgatctggtgatcggccgcttctggcgggtggccggcacacgcaaggccctccagggccacatccgccgggacggggtgttcacccgccgggaattcgcggaggagatgctcaaggccccggccaacttctactacggcgtgctgtggaacaagctctaccgacgctccattgtggaggagggccgcctgcggtgcgatccggaggtgagctggtgcgaggatttcctcttcaacctggagtacatccgccggacccggctgatcgccgccaccgcccagccggtctactgctatgtgaagcggccgggcagcctggtggccacccaggccaccctggcccggacggtggagatgaagcgcaccatgtttgccgcctacaagcggctctatcaggccctggacctctatgacgaacagaagctgcgggtctacggctacctggtctcagccgccaaggacggggggagcgtggccctgcggcccccggctctccccaagcggcggccggagtccccgcgccgccgaacgcgccggcgcagaaccggaatggcataatgtccggagtcctgccgaaacgctgcttcggcaaattgaaaaagcggaacggcatagccgttccgcttttcgtttgctggaaagggggtcaggcgcggtccacccagatggggctggaccaggccatgtgctcgtccttctgggtgacgcgcaggtagtagcaggcgccgctcccggcggtgtcctccagggtgaagtcgcaggcattgcccgcgcaggcccaggtctggatgacctgattgtcccgcagcagctccacggtgacggtgtcggtgcccaaggcgctgccctcgatggtgacgggggcgtcgccgatggccttgacctcgctgcccatgggggcagagttgatcttcagggagaccaggatgcgggcgccggtggtgccgtaggtcaggcggtcatagatggcgtcccacacgtactcccgcttgagggcggggacgaaggcggccacaatgccgccctccacgccgtgctcggtctggtgggagtcgctgccggcggtgaagcccatccggtagccccgggccagggcgtcctgcacgctgcaccgctccatcttcttgatgttcttggtgaacttggagcgggcctcaaaggtctcgaagggggcgtggcgggagtagatctccacggcgcgctgcacctcgggatcgtggaagttccagtcggtggcggcgctcaccatcacccagtccgcggcggggtggtgggggatgcagagggccttgtaggcacggatgctgttgtagaggtcggtgggggtcatgccgcccttgtcgccggagcggaagatctcgccctcgtcgccccggtagtacacgttcttgtggccgtagtcgtacttgtactcgttgggagtccactcgtaggccagaaggcaggccagctcgccgtccttgttcatcaggcggcagttggtgcgcagcagctcccactcggactgggtcgtccagtcggggtagcagtcgtggtcggtgagggcggtgaagtccagacgggccttgtcctgggcccggtgatagtactggtccacctcgcccatgccgtcggacaggccgctctggccgtggatgtcgccgaagtagacggacaggttcccgtagccgttcttgtccagccaggcgcgcaccacgtcggcggggtgctcgtccaggcgcttgtcggcgttggcggggatgggctgggtgaagtcgctggggggcgccacatagtcgggctgctgggccagctcggcgggggtgaggtggttgtagatcacctgggcgttgcgctccatgtggccgttcttgaagccgaactgccacatcagatggatggtgtcgtcctcactcaccagcagcttggggtggacgccgcagtggccgtcgccgtaggacatcagcaccggacggctccagggctcgctgccccggcgggtgcacaccagcacgtcgtacttgctgcgggtgtaggccatggcctgaaggccggaggagttggaggccacgtggagatccagataccagtccacgccctccttgaggcactggggattgaccgcggccagggcgccgtcccggacggtgaggtcggcggagcggacggagtagacggccatatagccgtagtcgtaccagcccaccacggcgccgtcgggcttggcggcgatccacggggtggaggcccagtcctcgccctggctgaccacaatctcctcactccagcccgcggcggtgcgcgcccgggcaaagagcttgtactgcttgccgtcaaagccgtcgtaggccacgtagaggttgccgtcgccgccctcggccgcgccggcccggtaggcctcgcccaccacggacacggtctcggccgcgccggggccggcctcggtcagggggcacagcacggcggccgcgctgcccttgtgctgctccgtccagatgacgtgcagcttgccctgccaggtgaacaggcgggggaagaacagggcctcgccggaggcgacggtgagcacctcgccccactggccgtcccgatagcagcgggccaggatgcgccagttctcccgggcgtactcgctccaggcgtaccagatggcgccgccgtgggccagaatgacggggtggagcacctcgccgccgtcggagatctcccgctcccaaaccacctcatccccgcggcggcaggaggccatcaggctgtcgtggcgatccacaaagcgctgccagcacagatagacgtcggaaccatccagcgcgatgccggggaactgggcgttctcccgatagagatcggtaatgactcggttgttctgaatctgttccataatacctcaacctcagctttctattcgtcgtcgtacttaccgacaccggccgggggcttgatgtgcttgacaccgaaggccagcaccagcagggtcacaatgtaggggagcatctgcacgatctggggcgggaaggcctcgccctgaaggtagatctgcaccgcgtcgcagaagccgaacagcagggcgcagggcacgatctgcgcggggttgtaccggcccaggatggcgatggccaccgcgatgtagccgcggccggcggtcatgttgcgcacgaacatgtccaactgatccagggacaggtaggcgccgcccacgccggccagagcgccgcagatgagcacgccgcagtacttgatgccgtgaacccgcaggcccatggtggccgcggcctttgggttctcgcccaccatgcgcaggcgcaggccgaagcgggtcttgaagaggacgatccaccccacgaccactgcggcgaccatcacaaggaagctgacggactgctgggccagaatggggccgatgacggggatgggggcaaagaagtccagggtggtggagatggaggccacctggggggtggagcccttgttgttccagatgagctgcatcagcagggtggtgacggccagagccagcaggttcagtccgatgccgctgatgacctggttgaccttgtagcgcacggacaggatgccgtggaacaggccgatgaccatgccgcccaccatgcccagcaggaagccgaagagcacgctcccggtgaagtaggagccgagaacgccgaagaaggcgcccatcatcatcatgctctccaggcccagggccatgatgccgctgcgcaccgagaaggcgccgcccaccgaggccagcaccagggggatggacatggcgatggaggagccgatgatgggaatcaggttgttgagaatcacgcccatgtcaggccacctccttcttggtcttgcgggaccagcccgcggggttgagccgcttgagctccttcaccagcagcggggcggccaccagaatgaccaccatggcctggatgacgttgacgaactccaccggaatgctggtggtgcggttgagctccatggtgcccgcccgcagcgcgccgaacacgatgccggcgaagataacgcccacggggctgtccgccgccagggcggccacggagatgccggagaagccgtagtcgttggagaagccgttgatcaggcggcggtccacgcccagcacatggctggcgccggccaggcccgcgatgcagccgctgatgcacagggccacgatggtgaccttggccttgctgatgccggcggtctccgccgcgtccgggttgaggcccaccgcgcggatctcatagcccagggcggtgcggtccatgaacagcttgaccaggatacaggcggccaccgccagaaggatggcgatggtgagctggtactgctggaagatgcgggggagctgcgccgtctccagcacccgctccgtctgggccaccgagctgttctccgccagcatgggcccgttgagcaggtagtccaccagataggtggcgatggagttgagcatgacggtggcgatgacctcgttggagccgaacttgaccttgagcacgcccaccaggccggcgtagaggccgccggcggccatgccggccgccaccgccaggggcaggtggagcgccatgggcaggcccagatccagcatgcccaccgcagcggaggccagggcgcccatgtagagctggccctcggcacccaggttgatgaggctggccttcttggcgaaggcgaaggccaggccggtgaaaatcagaggggtggcctgggtcagggtctggacaatggcgcgctggctgccgaaggagccggccaggatggcgccgaaggcctcaatggggttgtagccgcacaccgccatgatgacgccgctgatgacaatggcgataagcagggagagaatggacagcagcgggccatccagcttgagcagaccgctcagagcacgctttttcatgcggttccctccttttccggcgcaaggctgccgccggtcatcagcaggccgatctccatgtcgctccaggtgtccggcttgccctcggccacgatccggccgccgtagatgaccgccagacggtcggacaggctgcgcacctcgtccagatcggcggagatgagcagaatggacttgccgccgtcccgcagatccaacaggcggtggtgaatgtactccatggcgcccacgtccacgccacgggtgggctgggccacgatgatgacgtcggggttttcgctgaacacccgggcgatgaccaccttctgctggttgccgccggagagggcgctgcaccgctcctgcaagttgggggccttgatggcaaactcggtgcgctcctgctcggcaaatctgcggatggcggaggccagccgcaggccgcggcgggcgaaggcggggcggcggtgatagcccagaatcaggttgtcctcgatgctcatctccagcaccaggccgcgggtcatgcggtcctcgggcacatggcccacgccggcggccaggaaggcggcggcgttgccgctgaggggcttgccgtccttgaacagctccatatggtcggggcggcgcaggcctgtgagtacctcgatgagctcggtctggccgttgccctcgatgccggcgatgcccagaatctcccccttgcgcagggagaggcacacgtcgcgcaggatgggcacgccccgctcggtgagggagaggccgcgcacggaaaagttttcctcccccacctgctcggcccggcgggtgacggagagctccacgtcgcgccccaccatcatctgggccagctcgttcatggtggttcccgccacggggacgccgctctcgatcattttgccctggcgcagcaccgacacccggtcggcgatctccatggtctccttgagcttgtgggtgatgataatgatgctcttgcccgcggccttgagctgccgcatgacccggaagagatcctccacctcctggggggtgagcaccgcggtgggctcgtccaggatcagcaggtcggccccccggtagagggccttcaggatctccacccgctgctgctcacccacggagagggtctccaccttggcggtggcggagatgtggaagttatactcgtcgatcatggcggcgacctgggcctccgccttcttccggtcaaagaaaacgccgcgcaccggctcgctgccgatgaccacgttttccgccacggtcatgaccggggtgagcatgaagtgctggtgcaccatgccgatgcccagggcgatggcctgggcggggcgggtgatggcgaccggcttgccgaagacgcgcacctctccggcggtgggggtggtcatgccgtacagaattttcatgagggtggacttgccggcgccgttctcgccgagcagggagtggatctctccctgctcgacggtgaagtcggcgccgtcaatcgcgcggacgaggggatactgcttgacaatcccgcgcatttcaactgcgttcaaacgtcatcgcctcccggcagattatcggccgctggggccggggtgtcccgcttactccgcgggctggtactggttggcggccacccaggcgtccagctcctcggcggtctcgcagggcaccagctcgccggcggtgatcttggccttgatgtcctccacggcggcggcgatgtcgtcgggcagaaccacgttggagtcggtgttgtcaaagcctacggagccctcggcaatgccgctgatgtgcacgccgggctcccaggtgccctccaccagggccttgatctcgttgtagacgatggtgttcacgtcgcgcagggcggtggccacgatgtagtcgggctcgatgtagttctggttgccgcccacgccgaaggcatagcggtcggcctccttggcggcggtgaagacgcccatgccggaggcgccggcgatgtgctggacgaagtccgcgccgcggttgtacatggacagggcgatctccttggccttggcggggtcgttgaagtcgcccacgacggcctccagcacctcgcagtcggggttgacgtagcgcacgccggcctcaaagcccactacgcccatgcgcagggtgggctgatcctggcccaggatgacgcccaccacgttttcgctgttggccttgtccatgccggacagggtgcccaggccggccaccacgccggtcaggaaggtctgctcctgccacttggtatagacggcgctgacgttgggaaggtcggtggaggagtcgatgtgggagatcttctgctcggggaagtcgatggagatctcgttgatggcctcggtctggtcggccgccaggccgatgatcaggtcgtactcgccgctctcggcgaacatgcggtagttgggcaggaagtcgctggcgctctgggtttccacatagtcaaactcgatgccgaagtctttttccgcctgctgggcgccggcgtaggtcatatcgttgaagttcttgtcgcccaggccgccggtggacaggatgatgcccaccttcagggcgtcgccgtcagaggcgccgctgggggagctggaagatggggcgtcctggccgccgccgcaggcggacaggccgagggtgagggtacaggccagagagagcgcgagcagtttctttgcgttcatgacagggttcctcctttaattcattcggcacagcagggacactttgggcgtgcccggcccaagcttacaagttgagtttaacaaagaaaacaaaaacggtcgagccataggcttgaccgtttttgggacgaatatgatatctttttccgcacggggcgggaaatgtcacaattttgatttttttgtcacgattttgacccccggcgctccgcctccggggacacgcccttgtactttttgtaaagccgggaaaagtatccgggggtggtatagcccgtctgtaccgccacgctggcgacgggcagatcggtggtctggagcagctcctgggcccgctccagccggtagcgggtgaggtaggagctgaagttctcccccacctcctccttgaactggcgggaaaagtgctccggcgagcggtagagctgggcggccacctccgccatggagatgggctgggcgtagtgggcgtggatatagttcagggcggtctcaatgggccgggagtggcggctgcgccgttcccggagcacctgctccagcatggccgagcagcggctgcggcaggcggtgaaggaatggggcggctcccagccgtcggcggggggcgtgacgaactggtagtaccagtcctccatggagatcaccatgcggttgaccgtgtccaccgcccagcgcacgtcatcggctcccaccatgccgaacagggcgaaccaggcccggagcgccccgcgggcctcttccacctggcggcgggccaggaggcgcagcacctcctgctttctggcgtgggcggcctcccggtcaatggggggcaggccgtgaatggcggagtagggcaccacccctccgccggtgaagaagcaggcctcctgagccgccgccgcctcccccagcacacggatgagctggccgatgtcggtgcacagggcggacacgccggcgggcaggcggcactcccccagggcggcctccgtgtccagggcatagccccgcagggcctccgcctccgggcactggaggagcaggtagaggtgctcctgcaccatggcggccgcagagaagggggcgcgggaggcggaggctagggccaccatctgccgccgcaggtccaggctgctgtcgttggccacacagaaggccagatagggctggccgggccgcagcccctgccgctgccagaaggcggccacagcgccgggctgttcgaaattgcggtacatctcgtagaggtccaccaccccgtcctggaggacatcatgcaccttttccgagcggatcttcgccgtggtggccgcaatctccgctacgatgcgctgaatgtcggaggagcgcatctccgacttgaggatgtactcccgggcgcccagggagatggcctgcttggcgtaggagaactcggcgtagttggtcaggatgatgaacaccgtaaaggggaggatgtcccggactttactcatcagctccagcccgtccattcccggcatgcggatgtcggtaaagaccacgttgggcttctgctccaaaatcctgcggtaggcctcctctccattgaccgcggaggtgacggagctggccgcctcacacttctggatgcagtacaccagccagtcccggatgggggcctcgtcgtccactaccataatatgaagcatggagctcctcctttctctatcgggtgcggggcaggcggaaggtgaccaccgtgccgcccgccgggccgccggtgaccgtcagcccgtagccggggccgtagttgaggcggatgcgctcctgcacattcttcagccccacccggttaatctgcaagtccttgttcatcacctggtcgatcttgtctttggaaatgcccactccatcgtcctccacccggaggatcagggtgtccccctccagccagccccgcaggcggatgtggattttgtgccggcctacgccgtggaagatggaattctccactaccggctgaagcagcagcttgggcagcgtgttgtcccgcagggcctcatccacctcgcaggagtagtcaaaggtatcgggatagcgcaggtgctggagctccacatagcacttcagcgtgtccagctcctcccccagggggatgaactccaccgagcgggagagagtctggcgcagcagcttggagaagtagaacaccatctcccccgcctcctgtaccttgtccatctccagcaggaagcggatggagctgagggtattgtagatgaagtgggggttgatctgggcctggagaaaatccagctccgccagatgcttctcccgctcctcccgtttgaccgactccagaagggtggagatctgctccaccataccgttgaaggcctcctgaatacggccgaattcgtcctttcggcgtacgtcgatgcgctcgtccaggcggccctccatgacccggcccaggctggcctggagctgggtgatggggcggagaatctgccggtaggcgtagagaagcaccgccagaatcagggcggcgcacaggccggtggccaggaaagcgccattgcgtaccagattcagcgtgccgaaggccgccgaggcactcatctcctccaccagataccagtccgtccccggtatgcgttcatacaggcggatctgcccgccgtcaatgcggcgggagagggacgtctccgccgccagggcgtccaattcctccggggtataggcatagatggaaccaatgagctgcttgtcccgggctgagacaatggtgcccgacccgtcggtcagaaaaaatcggttgtcggcgctctggtgccgcagatattgggagtacaggctgacctcgctgatgttgaggatgaccaccccaagcggctcctgagtcaggtggtcccggataagctgggcgtactggaaggagtggacaaagatgcctgtggcctccggatgggtggtggtgggcagcagcagggcgtcctgggttccgctgaacaggggcccataccgggggtcggccaggacggcgtcatagttgaactgcctggagctgtaagtggcagcggtcacgccgttgaagcccaccacataggagtccatcagcattttgatgccccgctgccacacatagtcgctgctcaggctgtagagcagatcgtgggcggcctcgtccgcccgctctccggcggggccggagagcagttcaatgagctgtgtgctctcagcgatgcgcttggccagggtctgggtatcggtcatgccctggccaagggtgtagctgatctgccgcaggcccgcctggttgaggcggatgtactcctgccccaccacctggcgggcgtagtggtaaagagccagctccacggaggcggtgatcagcagcagcagggcaaacagcagcgcaaacaggcggaacagaaagcttttgcgtcggtgcatccccgcgccccccctaaagactgatttcccatccagttcacccgaaaagggagatatatctgatctattctaccacattgccccccgacgcgcaacgttggccgcagaatgaaaagcccccgccagggagggcgggggcacggtcagcgcaggaggacggcgcccagtccggcgctcagggcgtacgcccgccaggcagtcatctgctccggcgtgggggaggggcggccggccagagcgccgcgcaccccgttagggcggaaggtgatcagcttgacgggggtggagggggccctggggcccagcgcggcggccactccgtccagcacggcctccacatccaccgcgtccggagcgcacaccacccgcacctccgccagcttgccgcaggcggacagaaaggccagattctccttcaccggggcgttgtccgccccggtcagggcccggtggacggcgggctcccatgccttcacgtccagcatcaccccgtcgcacaccgccatcagcccggtgaggggggccaggggaaccatgccgttgctgtccagcaggcagcccaggccgccggcccgggccagggtgaacagctcggtgagaaagtccgggtagagggtacactccccgccggagacggtgaggccccggataaagggccggctgggggcaagggcggagagcacctccgaagcggtcatgacggtgaccttgggggaggcgaaccgggggcacaggcggatgcaggcatcgcacccggcgcagcgctccgccgcccagcgcacccggtcgctctccagggacagggcccccgccgggcaggcgggcacgcaggcgccgcacccggtgcacaggttctgggtctccgggttgtggcagtaggcgcaggccaggttgcagccctggagaaagacggccgcgcggcagccggggccgtccacggtggagagggggagaatccggttgactggcgcggcggcgctcataccatccgcacctttcgctgggccaggcggttgacgtcgtagttggccgtgcccaggtgggtggtgttctggagcactacctggtgggcgcggaacttctccatctcgctgcgcttgaccagatagccggtgatgcgcaccaggtcggtgtccgcggaatagaagctcatgtagtgtaccccaagggcgaaggcccccttcaccacgtccagcagggcggcggggttctgctccacattggaggcgatggggaagatgtcccccacccccgcggggaaataggggtggaaccgggcgcagtggcgcaggtggtcggcaaaggactccggctcactccccacggggatacgcacgccggaggtgatgcccacgtcggagtccaggcccacctgggcgtggagcaggaagtggttcccggtcaggggggagtgggcggcggggagggttttcaccacggcgtcgatcttctccatgatgcgcacgcccagcgcgtcggcctccccgtcacggccatacaccagcccccggtcccggagcaggtggttgaccgcctcggccagaccggtgacgccgaacatgggcagaaagcggtcggcggagataaggccctcctggaccaggaagctggaggggaagaagccggactgctccaccaggaagcggatgcgctcgttcatgtagtcggtcgtcaggcgcaggcactccgggagcagctcctccacaaagtgctccacaccccgggcgtcgtccaccaggcgggtgagggtgacccgggtgagggtgtaggcgccgccccggatgggcaggatgttgtaacagctcgacacgccgtagtcgtcaaaggtgtcccggttggcgggatggctgcacagggccgggttggagcaggccagggaacagcggatggccgcctctgcaaaggcgtcgggggtgacctcggggtcgtacttcagcgtgaagttggggacggtgttctgcacctcggagagcacctccagcagcaggcggcccgcccgggtggccgccgggcccaggttggcatggcagaaggagtcggtgatggtgcggtccagatagttgaggaagaggcgcagcttcctgcgcgcctcctcgtcgctccagccgtccaggaaggggtcgatgagggtgtccagattgcccaggtacaccgggaagttggtgatggacggcacatggcggtagagcgtcatcagggaaaagagcagctcgtccagatcctgaggcggcggcaggcggaggaaggcgctgccctggcggacaaacgctccgtagtcgggcaggatgtaccgggggcggtagggggcgtgcccctcaaagaggtcgttgatggcgccggtctcaaagaaatggcgggtgcggggcgggatgtccagcacgtcgaaggcattttccgcctccttggccaggttcatcagcttctgctcgtgggtaagggtctgcgaggtcagggtggcaaaggcgctgtcggaatgaaacatgaaaatccctccatcagtgtatggcccggccgtcggccaggcgccgctccagctccgcgcggagccggaggtattggggatggctgagctgaatttttccgctctggatgtcgaggaatccccgctcccggagggcgcgcaccccgcggttgaccgtgcgggagcacaccccggtctcgtcaccgatggccgggcgagtcatggggatgcaggccgtcccgcctccggcgttggcctcataccaggagaccaggaaggagagaaggcggctgtcgctgtccagagacaggtaaccccgctcccggcgggcctgctcccacaggctgcgcaccacctcccgtacccgggagagggtggtgtcccggccggagaagaaccaggagaagtagtcctcccgggcgagcacccaaaaccggcaggcggttctggcacgcacctcggccagaaagcaatttgccccgcacagggcctcgtactccccgaagagggtgagggggccgaactcggagtaggtgtgggaggggcctccgggctggagcccggaggcgtcggcccggccctccaccagcacatagacgcagcggcagggggcgtcctgccgcaccaccacctctccggcggcgcaggagagcggactggccggtgtttcatccggcaggccggaaaaaagggatgccagccgccggcgcagcgtgggagactcctccgcaagcagctcccgtatggtcatagggccgcacctcccgttccaattctgcccccattataacaagccactgcctctaaaaaaaggacatgtgtcttctttttggcgctttcttctgtggaagatcatattcttaaggatacctttatggatcgttcatagtccgttcaccaatccagggaaaaatcggcgtaagatcaacagcgtcaggaagaagtgacatcaacctcctctcatctctcttacctctctgtttacacacacaccggaacagggccggcccattgggccggccctgttccggtaaaatatgctttgatcagcctccgattcagccgggaggctgatttttttgtcccggtgtacgggagtgtccctcaaaaccgccgatcccacccagggacggggggtccgatccggggaggcggtggcagagccggcgaagcggatgtaggatgccgcatagagagggggggacaggcgtggccagactggcagagctggcagacggctacatggacgcggcggtgcggctgcggatggggttggaggaggtcagggcggagttggagaccgccgaggacggtcggcggcgggcgctggaggggagggccaagctgctccggcagatgctgaaggagatgcgggatttgcgccaactggccgaggggtattataccaggccccgggacgggacctacagcatgtcccagatctacgcgccccgggtggacagcacgaagcagtgagggggtgtggaggatgactgaggcccaggaggtgcgtgcccgggccaaggcgctgcgggagcgccgggaggagctggagaaggccctggcgggggctgcggggccgggtgcgcgccccctgcggctggagctggcccgggtaaaggaggagctggtggactgcgcccggcggctgaaggagctgatgccaagccacaaggtacgctgccgcaccacttgggcgggggtggacggatggcagtgggacaggtttcagtatcagacctgggccgagctggagggcgccggggagcaggacggccccacggagctggaccgcatgcgcctggccgtccggctggcccgggagcgggcggtgacggacaagcagggggagtatctggcccaggtagagggagggaaaaaggccgcccaggtggcccgggaggcggggcgccaccgggggacagtgagccgcaccgtgggccggggccgtacaaagattgccaaggaggcaaaggcgctgtatgaggtactccaggcccagcaggggccggggccgctggtggtggatctggcggacggccgggtgctggaggcggtgctctccctgctgacgccgcggcagcagctctatctctatctatactatggggagtggctgagcctgcgggagatcggaaggctgctgcgggtagaccacgcctcggtgctccgctccatccggtgcgggctggagcggctgggaacgctggcggtgggaaccagggcggaggtgcgtgggctggaggagctggaggagcggctgatggcccacttcaaccagttggagccgccggaggaggcgctgcgcccccggcccaaggcaccggtcagggcgcccaatccccggcggcctccggcggagcggccgcccctgcgggccatggtgctgcggctggtgcggggcggggagacccgcacggccgagctgggggagggcctgcgccggacggagggcggccgctgggggagcgggaagctgctggccgccctggaggggtgggtggagcgcctgcccggccggggcagggaaaaggaggggaggcggcagaagctgggccgcctgctgctcaaactgtttgaatggatcaggagggaattgtatgctgaccatcatcgaaattaaggacagggaggacggcggccatggcctgcagagccagagccaccggacggagtgctggctggaggggtggcttgccgtaccgccggagctggagcagacggcctgggactgtgcgggctactgcgacctggacatacaggacggcaagctggtgggcctgacgccccgggagcagccgcccaagccggagccggagccggacctgacgccccagttccgcacagccatgctgtcctatgcggccaccagcacagccatcccggacagctatgccctggacatgtccgatctgtttcccacctgggcggcggtactggcagacggcgaggagctgcctgaggggcgggtcctcaacgacggcggccagctctaccgggtggtgcaggcggtgacaccccaggcccaccaggccccccacgacgaggggatgctggccgtctaccggcccatcgaccgggagcacgccggcacggcggacgaccccatcccctgggtgtacggcatggattgccatgcgggcaagtgctaccgctacaacggcaaggtctaccaggtggccgagggcggggatatgatcccctgcacctggccccccgacacccccggcatgtggcagtgggaggaagtgcaggcataagatgaagggggcggatttgccgcccccttttgaaccacaggagaaaggatgagagccatggagcgagcgaacggagggaacagcaatgctgaacagccgggatattgatcggctgcgccccgacgtggcggccaactgccgcgcctggctggagctgtgccgcgcggcggggcttctggtgctggtcaccggaaccgtgcgggatgaggagtaccagcaatactgctatgaaaacggtacggccgccacgcctgtacccagctttcacggggagcaggcggggctggccttcgacttctgccagaacatcaagggacaggagtattcggattccacattctttcagcgggccggagagctgggggaacaggtgggctttgagtggggcggccggtggaagagcttccctgaccggccccatctccagtggagcgacggcggaaaatacaccagcagtatgatccgggcgggggactacccgcccgccatgcccccatatcgagaggaggacaccgacatgacgaaagaggaaattcaggccatgatcgacgcggccgtgacggccgcccggccgccggtctacaccagtgtggagaactgccccgcgtgggccagggagacggtgcagaaagccgttgacgagggagtgctgcggggagaccagggcggcggactccgcctgaccgacgacaacctggttaaccttcagatgctccgcaacctgggcttgctggacgggggcggggcctgatggaccacatcaacggcttcaaggccgccgtagccgctgtcctgggctgcctgaccgccctgtggggatggttcggctggctggtggtggcgtgggtggcctgtatgctgctggactacgccaccggcaccgccgccgccctcaaggcggggaagtggtcctgcaaggcggcccgggagggcctctggcacaaggtgggagccatggccgccgtcctggtggccgccatcctggacggggtgctgggcttgatcctggatcatatccccgccctgaccctgcccttcgattatacggtatttctcacggtgctggtgctggtctggtatatcctgaccgagctggggagtatcgtggaaaatgccgggcggctgggagcccctttgcctgcatggctgtccaaggctattgcagcgctggagtccggcgtggacagtaccggagataaactgacccaaggggaaaaaaaagaataaaaggaaaaagcctgtagtcaaacgactacaggctttttcctgccgttgagacagacggtttttacagtggaccggagaggcctgctatacttcaccctgtgcgagtgcttcggtgcccaatagggtaaggcggagtccctgccgggttttccctactgatatgtagccggactccgccagtcggcgaattcttaatttcagcttggcctcggtaaaacccgccgccaacaaaggcgaaaggcgaagcagggaaccgcggcctgcagggcgcccggcggcggtaagctcctgaatggagttcaaaaggaggcggtcttcctgggacagtggttcagaacagtcggtgaacgcagaaattcggtggccaaaaaagttgcgaattaaatcatttaaaagcgattgctgctgatcaggggcaatatcctgctgataaaaaatagtcaggttactagaaaaagcccgcagctcgcggacgttcccgggccatgtataatgtaaaagtctgtgctctaattgtgctggaagtcgcgcaccctcggccatggaatggagaagttccgggatatcctccacgcgtttgcggagcggagggataactaggggcaggatcttgagtcgataatagagatcctcacggaaggtaccctgccggaccatctcgttcaaattccggttggttgcgcagataacccgtacgtcaatagggatcacactggtggagccaaccggcatcacttcccgctcttccagaacccgtagaaggcgactttgaagagagaggggaatgtcgccaatttcatcaagaaaaatggtgccgttatcggcggtttgaaagaggccctgctttccccctttgcgtgccccagtaaaagccccctcttcataaccaaaaagttcgctttcaattagggtatctggaatggcggcacagtttacggccacaaaggggctttgacggcgacgcgaggcattgtggatggactgggcaaacaactccttgcctgtgccgctctccccaaagatgaggatggtctcatctgtaccagaatagtactgtgccaggcgaattgccttttgaacagcgggggagtgtcctaaaatgtctgaaaagtggtacttggctggcaaggagttcttttttacaccatgagagcaccgtttttcggaggaggacgcggcgattggggtgagcaggatgaaacagtggcggtgctggaggggggactcgaagtggaggtgcagtgtatagggctttttccctaaatatacgacttccttttcctcacgaccttcggacagggaggcggcgaggtgggccaactctggaaaacacgggagaagcgggtggccaggcaatcccttctgtccggcgggcaggagacgggcggcggcctcgttcagctccacgatctgttggttctcatccaggtggaacagagcagtgcctgtaagagcgagtgtctgggataactagcttttgagtagttggttctgggtgtggatatcttgtcggtggtacagctcagataccagttgctgcatcaccggtatatggaactggttcaaaaagtcaggcggcagattatatattttgacaatttcagcaagagtagagggagtgatatttcggtatcccaggttgatgtagacctttttgttttctggacaatagctgcgaaaaccggcataaacaacggtgtcatagggagtagtgtctatgtcacagccgggccaataagggatatagttcagatgattgatcccgagctgttgcaggttttctaccaaatcctccgcaatccgtctgggcttgtttgcaaccagcactggcgtaccttcgggcagttccaaaagccgatgtaagtgattgctgtccaaaaaacgccgggcaaatatgatttggctgtttggaaaatatttgtcggcgtacgcaagggaggtaatattgaccaaaatagcggcgggttctgccgcaagcgtgtgtacggtggcaagggtaacagggacaatatccagagacgaggaaaaaacctgtgagagaattttacacatatagttacggtccagctcgttttccgtaaaaacaccaagagtttgtttggccatagggtgtccctccttgaagcgcatgggtgaaacattgcctcttaaaaggataacagacagagcatggcccgtcaatgcaatttggacattattaaaatgatttaagatatccagatatgagatacaaacagatgtatgagaagaaaaggataaaacaaatttgtgggattactccaaatatctgcaaagtattttggctaaaaaataaaaaagtttaaaaaggattcatttgcagcgatatggaattaaaattgcttttgataatagcgtctgagggacctcggagagctgccagcgtacagcaggttaataggcaacaaagtatgaggaaaggaaaggcggaaaatggagttgggaatcaagggaaagagagcggtagttactggggctggtcagggtatcggccgggaaactgctctggtcttagcccaggagggtgccgtggtctgtgtaagtgacatcaatgacagccgtggaaaagaaacagtggaggaaatctgtgggagggggggaactggaatctatattcatgcggatgtgggggtgccggaggagatcaagcacctctttcggacggctgcagagcggttgggaagcgtggatattttaattaataatgcagcgatctcccccaaagttccatttgaagatatcccgctggagcagcttgaacaggttctgcgggtaaacctaatgggggcatttctctgtgcacaggaggctgcggcgcagatgaaagaaaaacgctggggacgcattatcagtctggcctcaatggcgggacgttttggggcaaataagtccggagcgcactacgccgctaccaaggcgggaatcgttgggatgactctaagtttggcaaagacactggggccgtacaatatcactgtaaactgcgtatcgcccggccgcattaatacggaacttacgagggtgctgccgcagaaagtccagaacgaaatctgcagtcagatacctctggggcgtattggagagccgtcagaagtagcctccgtaattgcatttctggcatcagagcaggccagctatgtatccggctcctgcgtggatgtgctgggtggttatatcgcataaagcgaaggagaataaaagaaaaggaggctaaaacaggcggcagagcaatggaaaagagagcaaaagacgtttttgtgaggtggaaaacatgttgacaatcatactggtggtagggtacttcctgttttgcgtgggcatggccttttttctggactacagaaccaaaaaaagaaaactgaatgaaaccgcagtggagtactctaccggtaaaaacagcatggggttgtttatggctttctcgctgatgtgcggcaacctgatcagttccagctacattattggcaactcatctgcagttattgagcatgatatcgcctatcagtggaccttctacggctatatcatcggctgggcgctgacctgtgcctatatccccatttatcgctccatctgctataaatatggctgttcctccttgggggaaatccttggaaagctgttcagcaagcgggtatccgtctgtgtgtcggtcatgatcttcgtatcttttgccagtgcggtcagcgcacagacggtcatcgtctccaatctgcttcaatccctgctgggcatccgcagcgaggttaccatgaccgtcaccattgcggccatgatcctgctggcacttcagggcggcatgaagggtctggcccgcatcaatatggtgcatgtggttgtacttagcgtgtccgttgtggcaatttttattgcggtaatgacctctgtgggatgggacttcggacaagtttaccgtgcgctggagccccagggtacctttaagctcattggaggctccagaagcaattcctacatcatcggtacgcttgccattcagccctttgttacggttgtaaatgcattgtccatctctgcggcgatcggcgccaaggacgccaagaccgcacagaaggctcaatccatcatgcctatttttgcaattttcttttttggattggtcatcatagctgcctgctgtggcaagttcctgtggcccgacatggatccggggactgcctggtacaccattgccggtcattacggtcccgccatggcggcgctggccagttgcggcgtgctggcggccagtatgtctacggcgccgacctacatcatggtaatgtccagtactgcaatggagctctatactcccctgcgtaagagccctatgagtgagaagcagaaaatgtttctgaccaagctgctcattgtggtattcggaatcctgttccagttgctcggcctgctctccagcgatgtggtggacatcctgtccaacgcgctgacagtgcgcgcggtatgcggtttgacctttaccctgtttctgctctggaagcggcctaacgagaagtccattttctacagcatggtgttgggtatcatcgtatgtgttgtctggatcgtgtacggctacgtcttcggtacgagtccattcggtattcagattacctatgccggcggtattgtcgcactggcgacccagatcattgtcacgctggtcactaccaggtccggtgagcgctccgacagctaccagctttataaagaggccagaaaagagatgaaggctgcaattgccgcaggcaaacgtgtctgatagaaccatttactaagtctaaatcagaaaggtatggacaagcggatgaaaaagcatggaggaaatgtaatggccggcctgctggccgactatggtgtgacggcggtatttggtgtgcccggcgggcagactttgccgctctactacggaattttggatgaggggaaccgtatcaggcatattctcatgaaggatgagattgatgccacctttgccgcggacgcctacgcccgtatcagcggcggtatcggagtatgcgacgccaccgccggctgcggtgccatcaagtttatttcgggcttggcggaggcgtacaacacctccatccccgtcatcgccatcggttctgagatggagggggattggctggccgcccggtaccgcggtacgggctcccaagtggtagactccaaggaggtgctcaagccagtgaccaagtggcaggcgtgcctgccccatgtgaacaaaatgccggagttggtgcagactgccgcccagatggcggtcagtggccgtcccggacccgtatttatcgagtgtccatggcggcccttccgggaggaatataccgggccggactatgagagcaaccgaaaactggccagcctgcccgcccaccgtcctaccccgtcccgcgacgaaatcgacgaggcgatccaggtactaaaggaggccaagaggccggttatgctgctgggcggcggtgcttggcgttccggcgccagagcggagatcacggcgctggcagagcgcatggctatgcccgcagccgcctccctgaccggaaaaggtgtgctgcctgagaaccacccactgtccctgggtgtggtaggcagtctgggcggcaatgatgtctccagaaaaatggtggaggaggccgacgtgattctcgccatcggctttaagttcagtcaaaactccacctatggctggacaattcccaggaagggccagaaggagatccgcattgacattgacgagactgaaatgaataaactgcatactacagatgtagggctggtaggcgatgccaaggccaccctgcagcttctgctggatcggctggatgcgcagagagatcccactgctgtagaaaaagaaatcgcgaagttgtaccgcgcttggcgggaaaaaaaccggccggcggtggaggctgatgattgtattactccgcagagggtcgtctccttattgaatgaattgtgcggcgacgatacaatcctggcctgcgacgccagtttctcctgcggctgggcgggcagcttctttgacgtatatggtgcccgtcgtaccattcttccccggggcgccggcggcctgggctatggacttcctgccggcatcggcgcagcggcggcgcggccggggaacaaggtggtggtgctcaccggtgacggagggctgaactactgcttaggagaaatggcagtgctccatgagcaaaacatggatgtcaaggtggtggttctcaacaacagcatcctgggttggattaagtggtacgaggcggccatgtgggacggccgctttaccgaggtggacaccgaaaccatcgactacgccgcggtagctagggggctcaattgtaaaggcatatccattcgggaccccaggacccttcgggaagagctgaagacggcactggagctggaagggccagtggtcatcgacatcaccacagcggaaacggaagcatgtaagtttacggatgatccaaaggctgtggcctatatccgggagagcgcggagcagaaaaagcgaaagtaaaggcagctggatatgaaaaggggaaatatgccatgaaagaaatcatatggaaaccggagctgcaccgttttcggagctgcaaggagttcgtggaggaattccggctgggtgcgtccgacctgatcctgaccaacgagtacatctaccagccctacttcggggcgatgaacctggagtgtgccgtgctgtaccaggagcagtacggcatgggtgagcccaccgacgtgatggcggaggccatcctgcgggatgcggccgccacgggctgcagccgggttgtcgccatcggcggcggcacggtcatcgacatcgccaaggtgctggcggtgggcggcggggagagcattgacgagctgtacggcatggcgccggagctgcccaagcggcgggagctggtcctcatccccaccacctgcggcacgggcagcgaggtgaccaacatctcaattctgaaccggacccgcctggggacgaagatggggctggtggggccggccatgtatgcggacgcggcggtgctcatcccgcagctcctggaggggctgcccttcggggtatttgcgacgagctcgatcgacgcgctggtgcacgcggtggagtccagcctgtcgccgaaggcgacgccgtataccaagctgttcgggtataaggccattgagatgctcatccggggatatcagacgatcgcccgggaggggcgggaggcccgcctgcccctgctggaggacttcctgattgcgtcgaactatgcgggctttgcattcggtacggctgggtgcgcggcggtgcacgccatgagctacccgctggggggaaaataccacgtgccccacggggagagcaactacgcgatgtttaccggtgtgttgaagaactacatggagattaagcaggacggcgagcttgcggtgatgaaccgctatctggcggagctgctgggctgcggggttccggaggtatatgaccggctggaggatctcctgaaccagattctgcccaagaagccgctgcacgcctacggggtgacggaggcggatctggaggagttcaccaggagcgtgatggagacccagggccggctgatgggcaacaacttcgtccctctggatgcggcgcgggtgctgaaaatctatactgagctctattaaacggcagtagggcggcggaacttccgccgccctactgccgtctcagacgcttttttataagaaagaaaaacaggggttgacttttgtgtaacacaagggtatagaatggggcatacagggggaagagggccgcaggagcgccccaccgagcggaacgggtgccgcagtccagtttccgcgcggagggcgctcccggcgggcctcgcacgatcttaattgaagaaggagcaaagggctatgattaagtacaaagcaaagaattccttgaagtctccccggtttgccggtgtaaagaccttcatgcgcatggagcacgtggtcaccaccgacgacatcgactttgccgtggtcggcatcccctacgacacctgcgcctccttccgggtgggcacgcgcctggggcctgccgcgatccgcgacgcctccgccctggcggccaagccctttaacggcccgctgaatgtgggtatttttgactggtgctccggtgtggattacggcgatctggggtctgtgcccggctatatcgaggagtcctttgagctcatcacagagggaatgctgcccttctttgagaaggggattgtgccggtggccatgggcggcgaccacagcgtcaccctgcccgagctgcgggcctgcgccaaggtaaacggccctgtggcgctgattcactttgacgcccactacgacaccattcacgagtacttcggcaagccgtacaaccacggcacccccttctatcacgcggcgaaggaggggctggtggacacctccaaatccatccaggtgggcatccgcgaggggctgtacggcccggaggatctgaccaactccaccgatctgggctaccaggtgctgcgcgccgacgagtgccacaagatgggcatggaggctgttctgaaggccatccgcgcgcgggtgggcagcgccaaggccttcctgaccttcgacatcgacttcctggatcccgcctatgcgccgggaaccggtacgcccgtacccggcggcttcaccaccgcccaggccctggagctggtgcgcggtctggcagatctgaatatcgtgggctatgatgtggtggaggtctctcccccgtatgatcccaccggcattacctccattgccgcggcgggcctcatgcaggagttcatctcccacgtggcctataaaaagaaaaacggcattgtcttctaattttttgcactccacctcaactctctatattctcttttcgcgcaaaatccatccgggcccggccgatttttcggccgggcccggatggattttgcgcagagcagaaagacgacggcggagccgctaagactccgccggccgcaccggtacctggatctccatcagcgtctcgtcgggatcgctggtgagggtgacgtcaattttgtagaactgaaaaatcattccattcaggacccagccatgctccgccatatatgtatgcaggcgggcaaaggaggggtggtatcgctccagctcgcctctgcggtaattcatacacaggtaatcccccgggggtatcgtgcgcttatgctcggactcaatggcgtcacgctccacaaagatcatggggacggcgggaatataatcgtcgctgggctccagcaggtgccagtccgcgtagacgccgatacggtcgctggccaggatgggggccacctcgtccaggtagcgctccagccgggtgaaggcaaaggcgtgctcccgggagccgccggcaggctctccgaaggtaatcatataccgctggggaaaggcgcggcagaagaccttgtccaccggcgggggcggggtgatctcactcagaaagtggagcttgcggcgcagaatttcgctgagaagctgctgtttgcggatctcctcctccagcagctccaactgatggaggagaagctggtgggatttcctcaaattgcggcccgaaaaatagtcggtgatgtcgtggatggacatgccaagctgccgcagttccttgatggtgccgagtttttcgtattggcggatggaatagtagcggtagcgggtttggggatctacatagtccggtgtgatcagtccaatacggtcatagtaccgaagcgtttcgctggtcacttgccgcagcttcgcaagctctgtgatggacaacagattttccttgatgggactcaccccctgcgcggataagacattctatcacaggcggccggacctgtcaaaaggctcttatattagtgaaattaaataaaaatagcaaataattactgtgagaataaaacaaaatgctgcacgagagagaaagatgcattgacttttgtgtaacacaaaggtatatgctcgttacagacggaaagagcggccccccctggccgcactttttcctcagactcagcgcctcactgcggcaattccactttgttaaaacagagaacaaacggagggctttattatgcaggaaaataatatgtccgtttttggcaccgtgatccgcaacgaagagattgccgatttcatgcgccttctgaatctggcgcgcgaaatcttcaagcaggagctgacggtggtggagatcatgccgggcggcctgaccaataagaatttccgggccgtgaccgaagacggcacccagattgccatccgcctggccggacagggtaccgccaactatatcaaccgccctggtgaaaagcacaatgccggtgagatcgccggactgggcattgcgccggagatctattactacgatcccaagacgggttcacaaattgttgagtacattgatgcgcccaccatgcaccccgtggactttcagacccgggacgaggtactggtcaaggcgggagcggtcatgcgccgctatcacgacagcggcctggagttcaagacctcctttgatcccgtcgccaagattgacgagtacaaggccatcctggacgagcacaactacgggaagcgctacgagggctgggagcgcatggtggaggcgctggagtgcatccgcgccgcctacgccaagcagccgccccgccgggtgccctgccacaacgacgcgctggcggagaacttcatgctccagggcgagcagatgcgggtcatcgactgggagtacggcggcatgaacgacggctactacgatatcgcctgcgtctgtgtggagaaccccctggacgcccgctgcgaggatgtgttcttccgcgcctactgcggcggcgaacccagcgaggaggccaaggcccgcctgctgatcaacaagttcctggtgacctcccactggtctacctggtcgctggttcagatctgctacggcaaggacgcggacttctactgggagtacggccgcacccgtgcggttcaggcatgctccttcctggacgaccccagcttttcccgcagcctgaccctgctgggcggctgacgggcaggaggggcagcccatggaattcatcggaacgctcattacctatctcatgatggcctgctgtgtcgtcggcggaatctcctacattgtcaatgaccagtcggagctgggccgggcctttcaggacggcctgcacgccatggcgaacatgttcatccccatttgcgggctgatggcctcggttcccttcctgaaagtcttcatctccaaggtgttcgggccggtattcgccctctttggcggagatccggtggtagccgccgcgatcatcatgccgccggactgcggttccttcgccctggccaccgagatcggccagagcgcggatctgttcccggtgatcatcgccatcggcttcatgtgcgcctctaccatcgccttcaacgtccccatcggcctgtccatgctggacaagggggatcacaaatacctggccctgggcaccatgagcggcttcctctccgtgcccttcggcgtgttcatcaccagcgtcatcgtgatgtttacccacccggccatccgttccaccttctccagtgtgggcgagccggatcatgtggtgatgctgaccctggggatgctcctgcgcaacatgatccccctggtggtcatctgcgtgctgctggccctggggctgaagttctttcccaacgggatggtcaagggcttcatggtgtttggaaagctgatgaccggcgccctcaccctggtggtggtggcctgcatcctccagcactacaccggcctgtttaccgacattctgggcgtcggctggggctttgatcccatactggccgacgaggagaacaccttccgggccgtggagctgctgggcaccatcgccatgatgctcaccggcgccttccccatggtgacgctgatccgccggtatttgggcaagcccctggaaaagctgggccgtctggccgggctggaggccagcgggagcgtgggcctggtggcctgcctgcccaacggcctggcgatgttcccctttgtaaaggagatgcgcccccgggacaaggtggtgtgtatggccttcctggcctgcggcggatacagcctgggggacttcctggccttcaacgtcaatttccagcccaatctgctggttcccgtgtttgtggggcagatctgcggcggcatcatcggcatcctgtttgcaaagctcctggcggttccgcaggtgcgggcgctggagcgggagacggcagtgtgagacacgcggggcgggccttttcggcccgccccgcgtgttgtggttctccgtcttgggcagcagaaacgggcattcatctggatgccagcgttctcaaaattcaatgcaattcagatattgcaaagtctcgatgaaccaacttgaagcatgtccgggcctttgcgggccgcgccgtccccagcatgaaaatgcggaaaggggagccgtcctccgggcggtgaagatcaaaataaaaaggacatcctgacggatgtccttttctggtggagacgacagaactcgaatctgtgaccccttgcgtgtgaagcaagtgctctaccggctgagctacgcctccatatattggtgacccgtacgggactcgaacccgtgttaccgccgtgaaagggcggtgtcttaaccacttgaccaacgggccaggttgcccaagcggggcgggatactcctgaagggaagtcccaaaagacggcgcggtgccgtcttttggggtctggtagcggcacctggatttgaaccggggacactgcgggtatgaaccgcatgctctagccaactgagctatgccgccattgaaaaccccctgtcggacagggcaggattcagtatacgcgatcattcccgttttgtcaattgtttttttgaaaaaaattagtcgattttgtagccgacgccccagacggtcttgatgaaccggggattgcgggagggctcgcccattttttcccgcaagcggcggatatgaaccataaccgtattattgcggtccaggtatttctccccccacacgctctcaaagagccgctcggcggagatgacctggccccggttctcacagagcatccagagaatgtcaaactcaatgggggtgaggcccagctcccggtcgtagagggtacactcgtgggtggcccggttgatgaccaggccgttgaagtcaatgatgtcccggcagtcgccggccttgtcagcctcgttgtagcgggtgtagcggcgcagctgggctttgacccgggccatcagctccagcgggttgaagggcttggtaatgtagtcgtccgcgccgatggtgaggccggtgatcttgtccatgtcctccgccttggcggtgagcatgagtacagggaagtggtgctccttgcggatttccccgcagagggtaaagccgctgatgtcggggagcatcacgtccaggatggccaggtccagagcctggttccgcaccacggccagcgcctcggtgccggtaccgcacttgaacacggtgcacccctcgctcttcaaatagacctctaccagatcggcaatctccggctcgtcgtccacaaccagaatccgcgcgtccatggtatccgcccccttttccaggacattatagccaaagcggcggcggcaagtcaagggtggggcgtaattgtaagaaaaacatcagaactggcccggccaggagacgtgcccccggccggggctggttcagccagagacgcggttgagtttctctatgtccagcgtagtctgtacgctccggccggacacatcgctgctgtaggtgagggaaaagttggtggcctcggaggtgtaaaacgtgaaggtgcgggcgccgttggcggtggagctgtttccggaggtgcggaaatagatgccgaggtcaatgcgcgccaggccgccgaaggcgggcgtgatctgaagatagcccggggcctccagtatggctgacacggagtaggagacccggtagtagcccggctggagccgaagctgctgggtgccgctcagtgtgatattgcctgtggggtcattcagcagctcatagagcggaatctgtccgttgttggggacggatcgtacatcggagtagtaggaagcaaagacatcctcacccggtccacccgcaggaccagtggggccagtggcgccgggcgtcccttgcgggcctgtcggtccggcggcgccctggggcccctgtggcccggtggctccggctgggccgggaagtccctgcggcccggtggggccgtccatgccccggatgccctgagggccggtgggcccggtggcacctgccgccccctgcgggcctgtcggtccggtcgcgccctggggcccctgtggcccggtggctccggctgggccgggaagtccctgcggcccggtggggccgtccatgccccggataccctgagggccggtgggcccggtggcccctgccgccccccgcgggcctgttggtccggcggcgccctggggaccctggggcccggtggctccggctgggccgggaagtccctgcggcccagtggggccgtccatgccccggataccctgagggccggtaggcccaggcacaccctggagaccttggcctccggcagggccctgcggccccgtggttccagagggcccggtggggccctgcgctccggcggcgccctgggggcccgtcggtccccgctccccctgcggcccggttggcccggtggggcctgtgggcccggacggggagggcggacagggcggatatggggggcagggcggcggacagccgcaggggtcaaaacagtatttcatgacaattacctcccgggccattctatgctgtgacccaccccgccgccaaaggcggctagtgacttttctgaaaaagggtggtacaatcatttttagtataaatggaggcatcctatgaatgagtttgacgccctgctggcccgggcggtggagcaggccagagccctcggtatcccggtgtcggcccgcatctccccccgcgtggcggtcaaccgccgggcagtgacccggttcggctgctgtatccggcggggcggggagtatgtgattgagctgtccgagcggctgctggaggcggaggagcgggcgtgtatgcagaccctggcccacgaagtgctccacacctgccccggctgccgcaaccatggggccctctggaaggagtacgccgcgcggatgaatggggcctacggctatgccatctcccgtaccggcacctgtgaggcgctgggggtggcggatgtgcggccggtgcgctaccggctggtgtgcgaacgctgcgggcaggagttttgccggagccgccgctccccgctggtggatcacccggagcggtaccgctgccggtgcggtggcgtgctgcgccgcagcaactgaacctgtctggagaaggtgttcccaacggaaaagaaaaataagaaggccctgttcaatcgtattttctccatcgccggcctgtccatcggcggcgcgattctggcggggctcatcgtgtatgtggcccgtactatggatgtgcgggccctgctggcctccatccagcccctgtggctgctgggggcagccctgtgcgtccccctcagcgaaagcgtggacgcgctgatcttttacggtatgggccgctcggcgggctgtcccgtcaagttggcgggctgctttgatgcggcctatattggggagttttactacaagctgggccccgccggcgcgccggtgcagctcaagctgatgtacgatgcgggcatgagcgccacctacaccgcctccatctacacctggaaggcagtggccaacaccatggtttacaccggctatgcagtggccgccctggcctatgagctgttctggcggcgggaggggctgggccccgccgtggcgggggcgggggcgctgattgccctctacgtgtttctgtgcgggctggccctctttaccgccgtgcggccggagcctattcagcgtctgatccgccgcatcctcaccttcctcgcccgccactggaaggtgatggccagggagggcatggtggacaagggcatggaaaaggtggacgagttctgcgcacagctccgcgccctcaagggcaaccgccggatgctggcgggcctgttcgcgggcatgtttgtggagctgacggccctgtttgccattcccttcttcctctaccgggggctgggtctgacagggggctccttctgggagctggtgctggtccagtgcctggtgctggtgctctcccgcatcatcatgctcccaggcaacgccggcggcgcggaggggagcttctacctgttcatgggccccctgttcggccggcatctggcggtggggctggtgctgtggcgctttgccgcctttctggaggttctgctgctgggcggagcctggtcggtgctccgctttgcgcagcgctcggcggccggacacgggacataggaggagaacgtcttggatggaaaatatacccgccttaagctgaaaatgctgctgcttgtggtgctgggcaccctgatcgcggggggcgtgggcatctttctgctggaggtggtggtggatggggtgctccaggaccccttcgcccgctttttcctctgggcggccaccaccctgttcggccagagcccggagggggcggcggagctctaccagcgctatatccgcaacaacaagcaggagatcctcaccctgggtaccatgctgctgatgctcatcgccttctacctggccatgggccggtttacccgctggctggacgacatccgctcggccacccgccggctggtggaggcccaggcggagccggtggagctgccccgggagctggcccccatccaagaggatctgaatgccatccagcggcagctccgggcgcgggaggcggcggccagggagagcgagcagcgcaagggggatctggtggccttcctggcccacgatctcaagaccccgctgacctcggtggtgggctacctcaccctgctgcgggacgaccccggcctggacgccgcccagcgggccaagttcaccggcatcgccctggacaaggcccggaggctggaggagctgctgggggagtttttcgacatcacccggatggatctggacagcgggccgggggagcgccagcccatccagctgtccatgctgctggagcagctcgccgacgagttctaccccctctttgcggagaagcagctccggtgcacggtggaaattcagcaccacctagtggtgctgggagacccggacaaacttgcccgggtctttgataacgtgctgcgcaacgccgtcagctactccacccccggcggccgggtggacattcaggccaaaaccgtagggcgtcaggcggagatcaccatccgaaacgaggggctggagatccccgagggggagctggccaacatcttccagaagttctaccggctggacgccgcccgctcctcccgcaccggcggggccgggctggggctggccatcgccaaggagatcgtggagagccacggagggaacatccgctgcgagagcaacgggcggcttaccagcttcgtcatctctctgccactttataaggaggtgcgccatgtctttaaacgaaaccgcgctggcctgtctgaaccgaaataggctgctctacttaaacatgctggaggtgctgcgacggggctcggcggagctgctttgggccggggagggcggggtgctgctctatgaccgggggtcgggggcctacatgcttaccgcccgggaccgggccaccctggatgggatgctccccctgctgcctgcggactgtgacctgctggtgggccacgacctctggtaccgggacgagctggccggccgcttcggcctgtggaaggaggagctgtgcgtccaggccgcctggatggctccggagccgccggaggcgccggctttcggcggggagctgcgccttttgggggaggagtgggccccctacgtctgtgagcactacagcaagagcgatatcggcggcctggagcacatccggcaggccatcggcgccggtatgctgggggccttcgtggacgggacgctggcgggcttcgcgggcttccacggcgagggctccatcggccttctggaggtgctgcccgcctaccgccgccggggcctgggggaagcgctgctccggggggcggtgcggctggcgctggagcgggggcagtatgcctttggccaggtgcttatcgacaacgccccctccctggccctccagaaaaaggtgggcatgacggtcgcccgggaaccgctcttctggctgtttcgcagataaagagccatttggaccggccggaagcgttcaacagacctttttgacgggcaccggccccggcgcttttcgaaagcgccggggccggtctggtcagatggcgtggtagtcctggagcagcttctccaggtcggtgccatggagctttttgagtaccgccttgagggcaaggcgctcggccgggttcagccccagctcggtgagcttgcggccgtcccgaagctggacagaggcgttgatcagatcccgcacgtcgtaggtggagccccacacctcgggcacgccccggtcgatgtccagcagggtgtagaccgcctccataccggtgcgcatggagtactcggtggtaaagatggtgtcccgctccgtctcggcgaactgccccaggaaggcgaagttcaccgccccgtcggggacgacgcggggccggtccccggcggcacggggcaggaagaaggcggtgatgtagggcatcatgcaggggacggtattggcgctgtgggcggccagctccgcaatctcctcctcgggcacccccatgtggtagagccactccatgcagatctcccgcccggtgcactcccgcatgggctttttcacaaagttgcccggcttgtcgctgaacaggccgtagatccacccaacgagctgccccctgggctggtcgcggaactggggctggcggttgaaggtccagctcagcagccagttggagtccctggcggtgacgatgccgccggtgaccaccttcccggagaaggggtcccgctggcagatgcgctggacataggggggaattttgtcgtcaagggtggtgacggtggcgctcatccagttgctcaactccggctgggagcagaacttgtccggccggccgaaggcggggtcccgcgcggcgatgcgccgccacatgtcccagccgccgccgggcttcagctccggccggaagggggcaggggaatcctgggaacccagggcggaattctccacgcagccgccgggagtgaggaaaaccaggtcgttttccgtcagatcaatgtgctcctctgccccgtcccgcagcagcaccaggcggctggcctgcttgcggccgggccggaggtcgaactccacgtccaccaccctggtgttgaagtggaactggacgccatgctcctccaggtacttgagcatggggaggatcatggactcatactggttgtagcgggtgaagcgcagggcggtgaagtcgggcaggccccccacgtggtggatgaagcgcttgaggtagagcttcatctccagggcggagtgccagttctcaaaggcgaacatggtgcgccagtagagccagaagttggactccagcaccgcactgctgaacacgtccgtgatgcgcttgtcgtacagggcctcgtcgggggtgaagaacagcttcatgatctccatggcgccctgatcgctcaggccgaacttgccgtcggtgtgggcgtcctccccccggttgaccgtggcccgcatgagggagtagttgggatcccgcttgttgagccagtagtactcgtccaggacggacacgccctcggtctcgatggacgggatggagcggaacaaatcccacatgacctcgaagtggttgtccatctcccggccgccccgcatgacatagcccagtccctcgtagtgccagccgtcgcaggcgccgccggcgatgggctccttctccaggatgtggatgttccggccgggcatctgcccgtcccgcaccagatagcaggccgccgtcagggccgccaggccggagcccaccagataggccgatttatgctccacgccctccggcttcaccgggcgggcaaaggcctcgtaattgccgctggaataatacatgaaaatgcctccgtttcatagcgttgctttggattctggggccagtatagcccctccggaacggcggcgcaatcagcagaggggccccggtgatggaagtttcatcaccggggcccctctgtctcaattttgatcaaacgggcccgcctgatgggcggaatccgcccgcaggcgctccagcgcctgggcaaagctgcccgaaaccaccagctctacccggcgggccagctccgccggctctcccttcatgccggtgcggatccagtccagaaccagccccacaaaggcgtacttgtagaagtcggccagaaaggccttgtcctcctcccgcacctctccccgggggtccagctcctccaccacgcccatgagcaggccgtgggtgacctgaaagagaaaggtctccacctgctcccggcggacggagcggtagacgttgaggataaagggcctgttgtcgatcagcccgtccagaatccggcggaacccctcctgccaggtggtataggtgcgcttgccatccagtatccgccgggcgtcctcctggcaggcccactccaccaggtcgtagatgtcccggaagtggtagtagaaggtcatgcggttgatgccgcagtcctcggcgatgtcggtgacggtgatcttgtccagcggccgctccagcagcagcttcttgagggaggcctccagggcccgcttggtcacctggctcatggctcacctctggtccagcggcacaaaggcgcgcatgggggccaccgccttgtaggccgggcggatgatgcggttggcgggctggcagacctcctcgatgcggtgggcgcaccagcccaccatccgggccacggcgaacaggggggtgtagagctccatgggtatgcccatcatcttgtaaaccagtccggagaagagatccacgttggcgcacaccaccttctcctcccccttgacggtgcgcagcacctcgggggtgaggcgctccacccgctcaaagagctcaaactcgtccagcatgcccttggtctcggccaggctgcgggcaaaccgcttgaggaggacggcccgggggtcggacagggtgtagatggcgtggcccatgccgtagatgaggcccgagcggtctcccgcctccttccgcagcaggcggcccaggtagtcccgcaccgcgtcgtcgtccgtccagtcggacacctcggcctcgatgtgtccgaacatctccatgaccttcttgttggcgccgccgtggcggggacccttcagggagcccaccgccgccgcgatggaggaatagatgtcggtgccggaggaggagagcacccggcaggcaaaggcggagttgttgccgccgccgtgctcggcgtggagcaccaggcacagatccagcagccgggcctcctcgtcggtgtaccggttgtcgtggcgcacggagtagaggaagttctgcgccacgctcagcccctcctggggccggtggaggtagagggactcgttgtcgtagtagtgccgcttggccgcgaaggcgtgggccacgatcaccggtacgcgggcaatgagctccaccgcctgccggagctggttgggcagggacatgtcatcgggccgcccgtcataggaatagagggccagcaccgagcgggccagcttattcatcacatcggggctgggggccttgaggatcatgtcctcggtgaacatgggaggcagggcccggtgggcggagagcagtccctcgaaggcggtgagctgggcccgggtgggcagggcgccgaagagaagcaggtaggcggtctcctcaaagccgaagcggccctcactgacaaagccgttgatcagctcctccacgtcgataccacggtacaccagcttgccgggggcgggaatccgctcgccgtcctggacgtaatagcccatgacgttgccgatctgggtcaccccggccatgacgccggtgccgtcggcgttgcgcaggccccgcttgacgcggtagcgctcataaaaggccgggtcgatctggttatgcttctggtactccgcgcatagactttcaataaagtcggcggaggcgtccctgaccgcatggtccatatgcaacagctcctctgtctggtttcatttgtcccatattgtattctcttttcatcaaacagtcaatctgaaaaaagcaaggacgggcgaaatctgaatgatgctgaaacaaaacttgcaaaaaggagggggcggagggggaatgaagcaggtggtggccaccgccctggtgctgctgctcaccctgtttctgttgccgctgctcctgctgggggaggagccgcttgccgggccgtcccagccccccgccgccaccggcaccctgcccatcgaccgcaccgtggtcacccccggccagacggcggacggccgggtacaggtgcgggtggccctgggggacggggaggtgctcaccctgccgctggacaagtacctgtggcgggtggtggcggcggagatgcccgcctcctttgagccggaggccctcaaggcccagacggtggccgcccgcacctacaccctctccaagatggagcgcaccgtggaggcccacccggacgccgacgtgtgcacggacatcacctgctgccaggcctacatcgacccggcggacgccgccgccaactggggggagaacgcccagacctacaccgacaagatcgccgccgccgtggcggataccgacggcatggcggccctcttccagggccagcccatccaggcggtgttcttctcctccgccgccggaaggacggtggacgcggtggaagtgtggggtaacgcggtgccctacctcaccagcgtggacagccccgagggggacgaggtgcccaactaccactccaccgtcacggtgcccctggacgagttcaaaagcaagctgctggcccagtacccgcaggccgatctgtccggcgagccggcgggctggtttgccaaccttgtccccaattccgccggcggggtggagacggtggacatcggcggcaccaccgtgggcggtggaagcctgcgcaccctgttcggcctgcgctccaccagcttcacggtctccgcctcggcggatggggtcaccttctccgtcaccggctacggccacggcgtgggcatgagccagtacggcgccaacgccctggccaaggaggggaagagctacgacgagattttgaagtggtattacaccggcatcgacgtggccccctatacgccccagaggtgacaggcggccccggcggcacacatgccgccggggccgcctgaggttatcgataaaccctcctgccgaagatttcggagggaaggatagtgtgaaagggaaccgtcagggttccctttcgcgttggatcaaaataactgtttgaaacttttctgaagtttcaaacagtttggcagcctgtcgaaaagactttttcgacaggctgaggcggccccggcggcacacatgccgccggggccgctgcgtcagaaagagaggccgcgggcttcctcataggcggtgagccacggggggctgttggcggagtcgtagccggtggggaggatgccggcgctgccgacaaagctgccgccggcgtcatagacgtattccatatagccgtagtcctcaaggctgccgccgatcacgatgtcgtgggcggagccgtcggaggcggtataggaatagacatacggctccgcctccgagaattgcccggtgatgtccagctcctccccggtttctgtggtgaaatagacgctgccgccgcgcacagtgaggagatcaggctcctcccttaccggaaagcacacgttctcctgggatggtgcaaccgttgctccggcgtccggttcgttccagtttacgctgtcggttgatgtaaacgctccgccggagagcagcgggatggagcccagcgcgccggaggcggccagggcgcccgcagtgagggcggcggccacggcagcggcggcgacgaggatgcggatggggcgtctgggtttggtggtcatggcagttacctccgattcggtatgggagcagcgggaggccagggcgcgccgctgctcctccacccggttgaggggggggcaggtctgggccaggacttgctcaaaagtcctctgatagagcttcttcatagccgagttcctccagcttcttcctgagttgttgtttggcccggtagagccgggcggagagcgccggggcggtggtgcggaactggcgggccagctcggccaccgtgaacccctcgtaatagcgcaggtggagcagggcccggctgtcgggggacagcgcccccagggcggcaaacaggccggcctcctccggcgtctcgaaggtcagccgctccagggccgtgtcgtcgttctcccgccgcctgcgccagggggaggtaagcagatcccggcagcggttgaccgccacccgggccagccaggggcgctccttccctggggcagggggcttctccagcagggtgagaaacacctcctggcacacatcctccgcgtcctgaggcgagcgggtatagctgagggccaggccgtacaccatgggacggtattggtcgaataggggaagaaattccgcttcggtcatcccggagcctcccttcgtcgtttgtggccacatcaataagacggcggggcgggggcggatctgacggccccggcgggatttttcgggaaaaccgcattgtaaaccggcccgtcctttgttataataccatattgggacggagcgcaccgcctgatccctaatctgttgtaaagtgagagatcgcacatgaacacacgctatgacgttgccatcatcggctgcggcgaggccggcatcttcgcgggctatgagctgatgcaccgcaacccgggcctcaaggtggtcaccctggatcagggggccgacatctatacccggagctgccccatcgtggcgggcaaggtgaaggagtgcatccactgcaaggtgtgtgacaccatgtgcggcttcggcggggcgggcgccttctccgacggcaagtacaatttcaccaccgccttcggcggctggctcaccgacttcatgcccaagcgggaggtcatggagctcatcgactacgtggactccatcaacatgaggcacggggccaccgaccaggtgttctccaccgagacccccgccgcccaggcactggagaagaaggccctggagtatgacctccacctgctccaggcccggtgcaagcacctgggcaccgagaacaacctcaagattctccagagcatctatgaggaggtgcgccagggcgtcgagttccggttccgcaccgccgtcaccaaaattgagaacctggggaaggagggctaccgcctcatcaccgacaagggggacgaggtggactgcacttggctcatcgccggacccggccgctccggcgcggagtggttctccaaccagtgcaaggagctgggcatccagctcatcaacaaccaggtggacatcggcgtgcgggtggagctgcccgccaaggtgttcgagcacatcaccgacgtggtgtacgagtccaagctggtctaccgtaccaagcagtacggcgaccaggtgcgcaccttctgcatgaacccctacggccacgtggtggctgagaacgtggagggcatcaacaccgtcaacggccactcctactccgatcccaagctgcgcagcgagaacaccaacttcgccctgctggtgtccaaccgcttcacctcccccttcaacgagccctaccgctacggcaagcacatcgcctccctcagcaacatgctggccggcggcgtgctggtgcagcgcttcggcgatctggtcagcggcatccgcaccaacgagcaccgcatgagcaagtccttcgtccaccccaccctcaccgccgccgtgcccggcgacctgtccctggccctgcccaagcggcagctagacgacatcattgagatgatctaccagctcgacaagctggcccccggcaccgccaactacgacaccctgctctacggcgcggaggtcaagttctactccgcccggctggccctgtccaacgagctggagaccgccctgcccggcttcttcgccgtgggcgacggcgcgggcgtgacccgcggcctagcccaggcgggcgcgtcgggcgtgaaggtcgcccaagtgatttcggagcggctgaagtaagccccgccggcacccacccgattcggagtgctcgaagcagatttgacatctccagagaacggccgccgcaggcggcccctgcccgccggcagcccagcgcaagcgggtgccggtgggagcggaggagcaagggagcggacgcaggttttgccgtcaggcggaaccggagtcaagcggactttgcgacgacgcggcccaggcgggcgcgtcgggcgtgaaggtcgcccaagtgatttcggagcggctgaagtaagtcccgccggcacccacccgattcggagtgctcgaagcagatttgacatctccagagaacggccgccgcaggcggcccctgcccgccggcaacccagcgcaagcgggtgccggtgggagcggaggagcaagggagcggacgcaggttttgccgtcaggcggaaccggagtcaagcggactttgcgacgacgcggcccaggcgggcgcgtcgggggtgaaggtggcccaggtgatttcggagcggctgaagtaagccctgccggcacccacccgattcggagtgcctgaaataagcgtgcgttcaagtgcggcgccctcccctgcgggggagagcgccgcctttctgcacccctctgccgccggtgcatagaatggcctgaacggaaacagacagggggacgggtatatggacgaccggatacaggagctgctggagcgggcgcgggagaccgccgccaccgccggggagtacgccggacagatggtggacacggcccggctgcggggaaggctgttcgcccttcggacggacatcaacggcctgctccatacggcggggcggctggtgtacgacgctcaccggggcagcacgggcggagaggacgcgctggagcaggtgttctcggagctggaccacaaggaggccgcggcggccgagctgcggagccggctcgagcgcctccggcaggagaagccgctctagccgcggggaggcgggacccggacgggtcccgcttttttgcggctttttcggaaagggggcgggaagttgccctttttcattgcttttttggcgggcggggtgtaaaataccatgtaatccttgcggccgcagcgcttgcggcgaaccgtcagaccgtatttcgggcccgtccgggccgcttattacaaataaggaggacaagctttatgaactacacgtttgcccaataccaggagagcgcggactacatccgcagccagatcggcggctttgcccccaaggtggccatgatcctgggttccggcctgggctacatgggcgatattgtggaaaaccccattgccgtgccttatcagaatatcccccatttcaaggtgtccaccgcccccggccacaagggtcagctggtgttcggcaccctggaggggcagaaggtggctgttatgcagggccgtatgcaccactacgagggctactcctatgaggaggtgtcctacgcggtgcgggtgctccgcctgctgggctgcgataccctgatcgtcaccaacgccgccggctgcgtcaacctggactggaaggcgggcgatctgatgcttattgcagaccacatcaagttcttcatggagtcccccctgcggggtgagaacctgcccgagttcggcgtgcgcttccccgacgcctcccacctctacacccccgccctgcgggagatggcccgccagaccgccagggagctgggcatcgggctgcgggagggcgtctacatgtacttccccggcccccagtacgagactccggcggaggtgcgggccgcccgggtgctgggcgccgacgcagcgggcatgtccaccgcgccggaggtcatcaccgccggccactgtggcatgcgggtgctgggctttaccctcctgtccaacatgggcgccggtattctggaccagcccctctccgagcaggaggtgctggatgcggcggcggcctgccgggacaagttctcccgcctcgtgctggcctgcctgaaaaagattgactaaaaggagcctgccatgtctattctgatccataactgcaccgccgtcctcatggacgaggcgggcaccgtcctccccaacgcctatgtggtggtggaggggacgaagatccgctccgtcagcacccagcgcccctggggctcctttgaggagcagatcgacggccggggcaacgtgctcatgcccggctttgtcaacgcccacagccacgtgcccatgaccgccatgcggggctacggcgacggcaacaacctccaggactggctgcacaactacatcttcccggtggaggcccgctgggacgaccgggccatccgggcctgtaccgacctgggcctggcggagatgatcgcctccggcgtcaccaccatcgcggacatgtatggccacaccgacgcggtggcccaggaggtggcggcctccggcatcagcgccaacctgtgctgcggcggcgtgcagttcaccgacaccttcgaccccgccacccaccacgactgtgtggtgcagcgggagctgaccgagaagtggcacggctacaacgacgggcagattttggtggacgcctcgatccacggcgagtacacctcccaccacccgctctggcagtggatggcggactacgcccgggagcacggcctgggtatgcacgtgcacatctccgagacccgcaccgagcatgccgagtgcctggcccgccacggcaagactcccattcaggtgctcaacgactacggcgtgtgggacgtgcgggccatcgccgcccactgcgtctggaccaccccggaggactggtccgttatggcgtccaagggggtttcggccatccacaatcccatgagcaacctcaagctgggcagcggcatcgcccccgtccccgccatgggcaaggccggtgtcaacgtttgcctgggcaccgacggcgtgtcctccaacaactgcaccgacttcttcggggacatgaagctggccgccattctccacaacggggccaactgcgaccccctggccctgctgcccatcgacgccctgcgcatggccaccgtcaacggcggcaaggccctgggtcggctcactggccggattgaggggggctacgacgccgacctcattctggtggatttctcccacctgaacctcaccccctgccacagcgtgatttccaacctggcatatgccgcccacggcagcgacgtgtgcatgaatatggcccgcggaaaggtcatatacagagatggggacttcctcaccatcgacattgaccgggtgaagcgggaagtggcggactacgccctgcccctgctgtttgaaacgaaataagggggcctagcattgtccaatcagcaaaaaaagaataccttttacggcgcggccgctatcctgacggtgagcaccattctggtcaagattatcggcgccatcttcaagatcccgcttatcgccatactgcccgaggaggcctacggcgatttcaacggcgcgtataacatctactccttcttcctcaccatctccacggcgggcctgcctgttgccttgtccaagacggtgtcggagtgccatactctgggccgggagaaccagaagcaccgggtcttccgggtggcattctgtgcgttcctgttcatggggctgttcagcttcctctgcatgtcagtgttcggacaactggtagcaacctatatcattggcaatgagaaagccgtgttctgcgtgtgggcgctggcgccggcggtgctgtgcacctgctgctgctccgccttccggggctatgcccaggggcacatgaacatgatgcccaccgcgatctcccagatcattgaggcgctgtgcaagctcttcctgggtttgggccttgccatggtgatcatgagcctgaccctctggccggaggacatccgcaaccggctggcggcctccggcgccctcatcggcgtctccttcggcagcgttctgtcggtgatctatctggccttcaaccacttccgtacccgccggggcagcgccgcccgggccgccgaccagcccgaccggagccgggtggtactggcccggctgctcaagctggccattcccatcaccctcagttcctgctccatgtccctggtgactatcatcgacaccaacctggtgaacaatcagctccagaatgtgtttaccgccatccagggcggtatgaccggcatcagcaacagttttctggatatctttcccaaggctgtggagatctttcagaacaatacggatgcctggcagcaagccctgctgacagacccggccaccaagctggacccgatcctggactctgcccgcagcctctacggcacctacagtaagaccatgagcgtctacaacctgccctttaacctgatgatccccctgacggcctgcatcgtccccggcatctccgcctgcctggcccggagcgaccggctgggagccaagcggattaccgagtccgccatgcgggtggccgccctcattgccctgccctgcggcttcggtctgctggctctgggcggccccattatggaactcatcgccctgggcaatgtggatacggccatcgccggtcccatcctgtccatcctggggattgcctccatttttgtctgcttccagttggtgggcaccgcgatcctccaggccaacggcatagtgaatctgcccatcattacggttattatcggcggcgtcactaagattctggtcaactacaccctggtgggtaatcccaaaatcatgatcttcggcgcgccggtgggcactctgagctgctttgcggtgatctccattctcaacctgctcatcatcaagcggtgcgtgcccaatccgccccgctatctggtggcgctgtccaagccgctggcggcctccgtggtaatggctgccgccgcatggggaagccatgggttgctcgcccgtgtcctgaacggcagtctgacccgggatatggcggccaccgccggagcgatcctggtgggcgtggtggtatatgtaattttagtcctggctctgcgtaccctgacccgggaggacctggaaatgatgcccgggggcaaaaagctggctaaaattctgcatatccagtaagttttttggaaaaagaggttgcaggaggccttgaaatatggtagattttcagtataaggattcttacggcgtcaaggacttggaggagattgtccgcctcttgcgggcgcccggcgggtgcccctgggacgcggagcagacccaccagtccatccgccgcaatttcctggaggaggcctatgaggccgtggaggccatcgacgagggtagccccgagcacctgaaggaggagttgggcgacgtgttgctccaggtggtgttccacgcccttatggagcaggaggccggtcgcttcgatctggacgccgtggccgacggcatctgcaaaaagctcatcttccgccacccccacgtctttggggaggtgtcggtctccggcaccggcgaggttctctccaactgggaggagctcaagcggaaggaaaaggggcaggccaccaataccgacgcgctggaggccgtggcccgctccctgcccgccctgtggcgggccgagaaggtgcagaaaaaggcgaaaaaggcgggcttcgactggccggacgtgtccggcgccctggacaagctgtctgaggagctggaggagctgaagaccgccgtggccgagggcaccaatgtggaggaggagctgggcgatctgctcttctccgccgtcaacgtctcccgtttcgtgaaggtggacaccgaggaggccctcaacggggccaccgacaagttcatcggccgcttccgcaaggtggaagaggaggccgcccggcagggccgcgccctggagggcatgagcttggcggaattggacaagctatgggagcacgcaaaagagacttaagggcgggttcgccttaagtataatcagactggggtgattcccccagtaaacacaggaggagttatcgatatgaataaggctgaactgatcaatgcggccgccgagaaggccggcctgtccaagaaggataccgagaccgccatcaacgcggccattgaggtcatttccgactgcctggccgagggcgacaaggttcaactggtgggcttcggtgcctttgaggtgaagagccgcgccgagcgcatcggccgcaaccccaagaccaaggagagcatcaagatccccgcctccaaggtgcccgtgttcaagcccggcaaggcgctgaaggacatcgtcgcgaagtaagtcagaagcgcggagggtaggcgcataggggagctaagaggacatggaggcgaaaaaacaggccgggcgaagcccggcggcatttttcgcggaatggccgcttagcgacccggccatgcgcccaacccgcagcgtgacaggaagcgcggaggcgcgcggagcagccgcacagcgagccccgcagacgaaaaagcagttgcgccgcaggcgcaaggtgtttttcacggaggggtaagcagtgtggcgtcgcgcagccgccgcagcgtgacagcgtcagcccaagctttggatcactcgcttccgggcgagcccgaacgctcattcccgccgctgggcctccttttccccacgcgaaccgcttcgctgggttcgcgcgggggccacgaaggtggggagcgccctgcgccgtaggggcgggtgcccacacccgcccgcgggccgatgagggcatcggcccctacgcgcggaagaggagtgggtgcccaggaggccctttcgccgcaggcggcgcctcggcctcatcttcccaccgaacccgcggcgagggccctgaaaggggacgtaccccgtgttgtaggggcggggcttgtccccgcccgcgggcggccgcaagggccgcccctacaggggtgcacagaatggttcccccgcggcgctgcaccgggcccggcggaggcgtagggacgggtgcccacacccgcccgtgaggcgagtggccccatgtccggctgggccgcatccacagagagaaccacagggccgccgcaggcttgcggcggcccttgactatgttgactatggaggaggaagattcccatgcgactggacaaatggctgaaggtctcccggctcatcaagcgccggacggtggccaacgaggcctgcgacaacgcccgggtcacggccaacggccggccggtgaaggccagctacgacgtgaaggcgggcgacgtgctggagctgcgcttcggcgagcgcaccgtaaaggtggaggtgctgtcggtggccgagcacgtgggcaaggccgacgcccccgccctgtataaagaactgctgtgagggcggaccgcccccgccgcgctgagagcaaaaaacagccctcccacatatgggagggctgtttttttgtggcttacttgcggccgccgcggcgggagctgcggcgctccgactggcgcagctcggacagcttgctgtccgaggcggccataaactgcttgagccggtcctcaaagctggcgggctccgccggggcgggcttgccgcggaagccgccgccggtgtgcccgccggggcggcccataggacggccctggcctgcggggcggggcgggggatccatagcctttttgatggagaggttgatgcggccgttctcgtcaatgccgatgaccttgaccttgacctcctgcccttccttgagatgatccttcacatcgttgacataggaataggcgatctctgagatatgcaccagacccgacttgccctccggcaaggagacgaacgcaccgaactttgtgatgcctgtgacctttccttccagaaccgaaccaacaccaaactccatactgactgctaaatcctctctcataaattttcaatcggtgaaacggaagatatactcgcccggctctaccaggcccagcttgccgcgggcgatgtcggcctgccggtcgggatcatcgctgttttccacggcgtcggacaggtcggcgttgacctgcttctgggctgccacctgcgcctcggcctcggccaggtcgctctgggcggtcagaatctgctggcgcaggttcagcagcccggtggcggcgccgataagcagggccagtaccaccagcttggtcaggagggacgcttttttggttttcacaggcggtacctcctcccgacgcgcggcggtccgagcggtgcagctcatccatttccctggatatcagccttattctataccactttcgccgataatggaaggacttttttgcggtttttccgatttttttacacagcctcaggagaaacactaccggtagtgtaagcacacgccacaaaaccccaacgagatcggccagacggtagcccagtttgaggaaccagcggctcagcagccagaaataagccgccgcgcccaggaggacggccgccacaatgtaaaggcgcacttcgccgctgccggcggtggtggtgtagacaaacagggcgacggtgaccaccagccagaacagcaggtccagcactccacccagcagggggaggcggacgcgcacacggaggatgcggaacgcgtcgtacagcagccccaccgccgcccccatcaccagcgccccggcaaagaagagggcctggtcggtgacggatacggtcatttcagcggaagagccgggcaaacaggccgcccgccctgtcccgcccgctgtcctcgtaggtgagggagtcgatggtgccctccaccttcaaatccccgccgtccaggctcagcttctcgatgtgcagctcctccccccgcacgatgagggtgccccggttggtgagcatgacaatggtgttctcgtcaaagctctccacctcctccacgccggagactgagagctgttcgcgctcctccagaatgatgtgatgggccgcctccgcccgcggacggttttcttcgtacggcatggctctcccccgcctttccatagtcttgtctcatatatatgggacaggtgggcgggttatgccagggccctcagcggcggctgatccgaagggcgggggccaggcggcggctcaacagccaggccagcgccagcttgactgcgtcgggcaggaggaaggggaacacacaccagcccaacacggtgaacattcctaccggcccggcggagctggtgtataccgcgtagtaccagacggagccgaacaggtagcacaggatctgacccacgacggcggaaccgagaaagacgggggcggattttcccagccatcgctcggcgccccacatggtgagggcggtaaaaaggaagcccaccagatagccgcccgtggcacccagaaaggcccccaggccgccgtggaagccggcaaagacgggcagtcccacggcccccaacagcagatagacggtcaccgccagggtgcccagcctgccccccagcaggcccagtgtgagaaagacggcaaaggtctgtagggtgaagggaacggcggtggggatggagatccaggagcagacggcgatcagagccgccaggatgccggtgtaggccagttctcttgtcttcatgataggtgttccctcctgattgtaaacttaaaaatgattatagtttacatttaataaaatgtcaactaaaaagagatataggttgacgatttaggaggggacgggtacaatagagggcgaaaggaagtggagcgaatgctgcgggacgaggtgctggcgctgttaaaggcccgggaggggaagcccctgtcgggggaggagatgagccgtgccctgggggtgagccgggcggcggtgtggaaggccatggagtctctgcgggacgaggggtatgtcatctcctccgccccccgccggggctacgccctggagggctcgccggaccggctgtccgccggggagctggccggagccctggcgggccgccgggtgggccgcgcgctggtgtgcctggagacggtggactccaccaacaacgaggtcaagcgccgggccctggccggggccgccgacggcctggcggtggtggcggagcagcagaccggcggccggggccgccggggccgctcctttgtctcccctgcggggcaggggctttatctgtcggttctcctccgcccccggtgccctctggaggaggtgtcgaccctgacggcgtggacggcggtggcggtgtgcaatgcggtggagcgggtgtgcggcgtgcggccggggatcaagtggcccaacgacgtgatcctggacgggcggaagctgtgcggcattctcaccgagctggagctggaggcggagactgccgccctgcgccatgtggtggtgggggtggggatcaacctcacccagaccgcagccgacttcgggccggaggtggccccggtggccgtctccctggcccaggctctgggacgggccccccgccgggcggagatggcggcggccgtgctggccgccctggacgagctgtacgccgccttcccggcagagcgggcggcctggctggagcggtaccgggccgactgtctcaccctgggccggacggtgcgcctgctccgggcgggcgaggaggaggaggcctttgccgaggcggtggacgatgccttcgccctggtggtgcgccgcgccgacggcagccgggaggcggtgtcctccggcgaggtgtccgtccgggggctgctggggtatgtgtgatttccaaaagcgcgggacgtgtcccgcgctttttgcttgacaaatccgcctgttccgctataataagacaagttatgtgtcatgacacatgtaaaggagagacggaaatatgggagcatgcagcgcatttctcaagcgaaaaaatattgtcctctcggcaaagcggtatggagtggacgcattgggagccatggcccaggggctgttctgttccctgctcatcggcaccattctggacacgctgggtaagcagctcggcattgccttcctggtgacggtggggggctacgcctccgccatgagcggctcggccatggccgtggccatcggctacgccctccaggcgccgcccctggtgctgttttccctggccacggtgggctatgccgccaacgccctgggcagcgtcaccctgtccggcggcaagggggcgggcgggccgctggcggtgctcttcatcgccgtcatcgccgccgagctgggcaaggcggtgtccaaggagacgaaaatcgacattctggtcacacccctggtgaccatcctggccggagtgggactgtccgccctgctggccccggccatcggcaccgcggcctccgctgtgggggacgttgtcaagtgggccaccgtgctccagcccttctggatggggattctggtgtcggtggtcatcggcgtggcccttactctgcccatctcgtcggccgccatctgcgccgccatcggcctgacggggctggccggcggggctgccgtggcgggctgctgcgccaatatggtgggctttgcggtactctccttccgggagaaccgctggggcgggctggtcagccagggcctgggcacctccatgctccagatgggcaacatcgtccgcaatccccgcatctggctgcctgcgatcctcacctcggccatcaccggccccctggccacctgcctgttccggctggagatgaacgacccggcttccgccgtggcctccggcatgggcacctgcggcatggtgggccccatcggggtgtacgccggatgggtcaacgatgtggccaccggggccaaggcggccatcacctccctggactgggttgggctggcgctcatctgctttgtcctccctgcggtgctctgctggctgttcggcctcttcttccggcgcatcgggtggatcaaggagggggatctgaccctggagtgacagggcccggcgtatcgccgcgcgggcagcacgcggcgcgcgcctgtaggggcggcccttgtggccgcctgcggacggggaggagccccgcccctgcgatttcccgctgaggccgtcgaaaaacgcgttcggcaggctgcggcgcggctcttgccgcgccgcttttttgctgtgcaaaggcggagcaaaattggccgtgtgccccctgccgcgtcccaggcgcatgaagttttacgcggaattgacagatccggcccgcctgtgttgttatagaggtgaaagggggcgaggccatggacgggacgcgggcggaggagctggtggagcggtacgccgacgccatcctccgcatcggctacacctggctgggggacatggacgacgccaaggacatctgccagacggtgctcatcaagctggtagaggagggccgtcgcttccccgatttgggccaggagcgggcgtgggtggtgcggctgagcgtcaacgcctgcaagaactggaaaaagagcgcctggttccgccgccgggcgccgctggaggagggcctgcacctggcggcggaggtgccggagccggaggacggcgcgctgctggccctggaggcccggcggccggctcccagacggcaaatacccctgcggcgtgtggcggccctggcggcctgcgcggggctggtgctgggactggtaaattatcaggccgtagccgccgggacagagcgggtgatccgttacttcctgggggtgggggcggcggaggagaacctctccctgctggtgcagggggaggcactccacaaggaggacggggcgttcctctaccgcatcggcggggcctatcagcgggatgggatgctcactgtgccggtgagtgtttttaccagagagggggcgctggccgagggggaggagctgcgctaccgcctgctggtatacgacgccgacgggaagaagctgcggcgggtgtcctcttactatgacgacgccaagggtgagatgtcggcccccgtttttttaacagaggggacgacataccaccccagccgcctggatgtccttgccgactggatgagccgcacctattgggcccagggctacacggagggcgaaaccgagatctatcacatggaggtgcccgacggggcgaaggggccctataccttcgacgtggaggtgtactccaacgacgtctcccatctgggctaccagcccatgtgggaggggggcgtcctggccctggataccccccagactctggacgccgtctccgtcagccgtaccttccaggagggtaccgtcaccgccctggtgggggacgacgggcacagcgtggctttctatggggagctgagccccgccctggcggcccgggaggagaagctgcaacagttatgggtgcccatgctctattctgaggatgaggcgggccgtgtccagcctgtgccggcgatatggttcatcgacgaggcgggcaaccgctatcggggctgttctatctggcacatgcccgccgcgtgggtcaccgatgaggcgggcaaccgctacgagcgataccgggtcttccccggcccggcggaggagtactggccggagttccggctgctggaggagccagaggggaagattacggctatcgaggtggaggcgctggttttcaacattctgcgcaccgaccggccgcgggaggtggagacccggtcgtatacatccacttataacccgctgaactgggtgatcgagttgccctagatcacacacccgcccggcggggctccggccccaccgggcggagcagcctttcacatgcgctttccctccgaaacgcttggcaaaagcgtttaccggcagactcacccgccaggggggttctcctcttttccgccatagacaaaatcctatgggcggcgtataatatccccatactacatagattggggaacggtcatggacacgaatgccaacaataaccgtgaatccttcgaggatcagcaggtcatttttgtggatacccatctgattcagaaggcggtggagggactccagcgcgcccgcgaggagttccagaccctgctggagcaggcggagggcggagacgcctccgtctattacgaccttggcgtgcgctataccgagggcgacgggaccgacaaggacccggcccaggcggcccgctggtttgccctggcctcggaggacggggatctccgggccaccgacctgctggggcgctgttaccagtccggcgcaggggtggagaaggacgaggcccgggcggcggagctctttcagcaggcggcggagcaggactacgcccccgcccagtgcgacctgggcctgagctatgagaacggctccggcgtggagaaggacgaggcccgggcggcggagtgctacctccaggcggcggagcaggattacgccccggcccagaccaatctggcggtgtgctacttcaacggaatcggcgtggacaaggatgtggagtgcgcccaccagtggctggagaaggcggcggagcagaagtttccccgggcgctgaacattctgggcgactgccactgggacggcactggcgtggagcaggaccggggggaggcggcccggctctaccggcaggccgccgagcaggactatccccccgccctgtgcaacctgggcctgtgctatgagcacggggacggcgtggagcaggacaaggccaaggcggtggagtgctaccggaaggcggcggagcaggactacgccccggcccagtgtaatctgggcgtgctcacgctccacggcgtgggcaccgaggccgacccggccgcggcggcggagtggttccgccgggcagcggagcagagcttcgcacgtgcccaggatctgctgggcgactgctatctggacggcaagggcgtggaggccgacccggcccgggcggcggagctctaccggcaggccgccgaccagggctacgccccagcgctgtgcgacctgggcctgtgctacgagaacgccaacggcgtggcggaggacaaggtccaggcggcggagtgctatcggaaggcggcggagcaggactacgctcccgccatgtgcaacctggcggtgtgctatctcaacggcatcggcgtggaggaggacatggcccaggcggtggcgtggttccagaaggcggtggagggcggctccgcccgggccaagagcatcctgggggacttctacctggatggccgtggggtggagcaggacaaggagagggccctctccctctaccgggagtctgcggcggacggctacctgcccgccatatgcagtctgggcctgtgctatgagaccggcgacggcgtggcggaggacaaggcccaggcggtggagtggtacaccagggccgccgaggggggctatgccccggcccagaccaatctggcctactgctttctcaccggcatcggcatggaggcggcgccggagaaggccatcccctggctggagaaggcggcggagcagggccaggcccgggcccagagcctgctgggaagctgctaccgggacggcgacggcgtggaggccgacgcggcccaggcggcggagtggtatggaaaggccgccaaacagaactatccccctgctatgtgcagcctggggctggccttcgagctaggggagggactgaccgaagacccggccaaggcggtgtactggtacaccaaggccgccggggagggctatgccccggcccagaccaatctggccgtatgcctgctcaacgggaccggcgcggaacggagcgcggaggaggccgtaggctggctggaaaaggcggtagagcaggagttcccgcgggcccaggggattctgggggatctgctgctcaccggcaacggcgtgcccgaggacaaggcccgggccgtggagctctaccgggccgccgccaagggcggctatgtgcccgccatgtgcgacctggggctgtgctatgagaacggggacggcgtagaggaggatctgcgccatgcggtgctgtggtaccgcaagagcgccgaggagggctatgccccgggccaatgcaacctggcggtgtgctacctcaacggaaacggagtggagcgggacgcggccgccgccgtgcggtggctggagaaggcggcggcccagggaaatgcccgggcacagagcatcctgggcgacctgtgccgggacggggagggcaccgaagtggatgcggcgcgggccttccagctctatacccaggcggcggagcagggctatccccccgcccagtgcgccttgggctactgctacgaggtggggagcggcacggcggaggacaagaccaaggcggtggagtggtacgaaaaggccgcgcagcggggccatgccaccgctcaatgtaatctggcctactgctacgagcagggcatcggcgtggcggaggacaagaccaaggccgtggagtggtatgccagggccgccgagcaggagcaccccagggccatgtgcaacctgggcctgtgctatgagtacggcgagggtgtggcggaggacaagactaaggcggcggagtggtatgagaaggccgcccggcgggggtatgccccggcccagtgcaacctgggcttcttctatgaccggggcgtgggcgtagcggaggacgccgccaaggccgtggagtggtacgagcgggcggcggagcagggctatccccgcgcccagtgcaacctgggctactgctatgagagcggcaagggcgtgaaggaggacaaggcccgggccgtgaagctgtaccgccaggccgccgaacagggcagctccgtgggccagtgtaacctgggctactgcatgctcaaggggatcggcatacggcctgacccggcgcaggcggtgtattggttccgaaaggccgccgaaggcggctccggccgggccatgtgcctgctgggtgactgttaccgggagggccagggcgtggaggccgacgcggcacaggcccggacgtgctaccaaaaggccattgacctgggcttcgacgccaaggaggagctggaggagctggacaaggccgcccccgccggagcggcggaacagccgaagaaaaagaagtccttcctgggccggctgtttggaaaataggacaaaatcaatcgcgggccgcaggcattgcctgcggcccgcgattgtatgatccccggccgggcggggcggccgcctccctcagccgatgcgtccgaagtcggagaaggggaagcagatgaactccgccttgcccagcagatagcgcgtgtccacggtgcccagggtcacgtcccggctgtcgttggagtggttgcggttatcccccatgacgaagaccgacccctccggcaccgtcacggaggtgagatcctcataccagggctcctccatgggctcgttcagatagggctcgtccagggcttcgccgtccacatagacggtgccggtctggtagtcgatgtccaccgtctggccctccacggcgatgatccgcttgacaatgggccccctggcggcgtcaaactccttggtgagcaccacgatgtcccccggctggggatcggtgtagccgatgtcccggatcagcatcacatccccctcgtggagggtgggcagcatggactcccccaccaccggggtgatgcgccccacgaaggtgaataccaggatgatggtcaccagcgccacaatcaaaatctgaagccactcgtaggcatcctgagcgccgctgaggggcttttcttcttttttcggttttttcatgggcaaactccccgctttcgacaaaggaggggctgtccagcagcccctcccgtgcgtatcttatttcgcgtactcgatgaccttggtctcccggatcatgttgaccttgatctggccgggatactccagctcctcctcgatcttcttggcgatgtcccgggccaggagcaccatctgatcctcgctgaccttgtccggggccaccataatgcgcacctcgcggccggcctgaatggcgaaggacttctccacgccggggaaggaggaggtgacctcctccagcttctccagacgcttgatatagttctccaggttctcgcggcgggcgccggggcgggcggcggagatggcgtcggctgcctggacgatgcaggccacgatggtgcggggctccacgtcgttgtggtgcgcctcaatggcatgcacgatgtcctcgttctcccggtacttccgggccagctccacaccgatctgcacgtgggagccctccacctcgtggtcgatggacttgcccaggtcgtggagcaggccggcccgcttggcctgggtcacgtcggcgccgatctcagcggcgatcagccccgccaggtgggacacctcgatggagtggttgagcacgttctggccgtagctggtgcggtagcgcatgcggcccagtagcttgatgagctcggggtgcaggccgtggacattggtctcgaacacggcgcgctcgccctcggccttgatggtggcgtccacctcccgcttggccttctccaccatctcctcgatgcgggtgggatggatgcggccgtcctggatgagcttctccagggcgatgcgggcgatctcccggcgcaccgggtcgaagcaggagacggtgatggcctccggcgtgtcgtcgatgatcagatccacgccggtcatggtctccagcgtgcggatgttgcggccctcgcggccgatgatgcggcccttcatctcgtcattgggcaggggaaccacagagacggtggcttcggccacatggtcggcggcgcagcgctgaatggccagggacaggatctccttggcgcgggtgtcggcctcctccttgaactgggcctcgatctcccgcaccttcatggccgactcatgggtgacctcctcggcaagctggttgatgaggtagttcttggcctcctcggcggtgaagccggagatgcgctccagcacctccatctgggtcttcttgacggtggccacctcgtcccgggcctcgtccagctcggccagcttgcgctgcagggtgtcctccttcttctcgatgttctcggtcttgcggtccaggttctcttccttctgctggagccgccgctcctgcttctgtagatcggcccggcgctccttcacctcgcgctcatactcgttgcgggcctggagaatctcctccttggcctccaccagcgcctcccgcttcttactctcggcgctcttaatggactcgttgatgatgcgcttggcctcctcctccgcactgttgatctctttttccgcggtgcgtttgcggatttgaatgccgatgggaatgcctatgatgagtgcgaccacggccgtgatcacacaggcgatgacagtctgcatcaagggttcaacacacctccatatcttggattttcaaagttctttttcatgaaacggatgcacgcgctcccgctcactcttgggcagagcgcacaaaatttgaagagcttacccctcgttcttcaaaatattacaccttatctattttaagtctgcggcggccttctgtcaagaacattcctgttcggaatcaatttctgcggccctgggcctcaaagggatcggggcagggagtcgtcctcccgcacccagtcggccacatctaccacccggtactccgtgcgggtgtcccggatgaccacccgggcgatgccggcgttgatgatgaggcggcggcacatggagcaggaggtggagccgggaatcagcgtcccggtgtccggctccacgcaggccatgtagagggtggcgcccagggcctcgctgcgggcggcggagatgatggcgttggcctcggcgtggacggagcggcacagctcgtaccgctccccggaggggatgttcagcgcctcgcgggtgcagtagttcagatccacgcagttgcgccgcccgcggggggcgccgttgtagccagtggagatgatctcgtcgctcttgacgagaatggccccatagcaccggcgcaggcaggtggagcgcccggccactgtctgggcgatgtccagatagtaattctccttgtcgatgcgtcccataaacgcccctcccatgcttttttaccagtataccgggtttttcgctatcccgcaagccccggaatggctgccccgggcggacaattcacatattgtttacgtttccttccttgacgaagaaacagggaggcgctatcataagttcagaaaaaatttatttttaacttcaaaggagacgaccgtatttcatggtgatgaacttcattcgaaaattgatgtacggccggtatggaagcgaccagctctcctttttcctcctcgtggtctatatcgtcctcattcttctgtccggcctgccccacctggaggtgctctcctggctggcgctggcagtgctcctgtgggatctgttccgcatgttctcccgccgtatcgaccgccgccgggcggagaacgcccggtttctggctctggccggacccgccatacgctggctgcggatgcgccgtaccatccgccgggacaaggagcaccgctacttcaagtgccccaactgcggacagtatctgcgggtgccccgggggaaggggaagatcaccgtcaactgccgcaactgcggcgccagctttgaggagcggagctgagctttcaccggccggggccggcgcgccttgccgcgccggccccgctttgcctttacaggcgggcgaaaagctggtatcatagcaaagaaagtgggtgaagccattgagacagtgtatggatgcggacaacctccaccgcagactgaaaaagatcatcgggcagttgggcgccatcgacaagatggtggatcaggacgtgccctgtgaggacatgctgatgcagatcaacgccgccaagagcgccctgcacaaggtgggacaggtggtgctggaggggcatctcaaccactgcgtccgggacggcatcgagcacggagacgcggaccggaccattgcggaattcgccaaagccatcgagcacttctcacgtatgagctgacgctgatgcggcccgtttgggccgcttttttcttgacaaataatacccatgggggtataaatatacctatagggggtatgggtatatgagacgggatatcacattccttgcgctgggagggggttccctcctgttgagcttttttgccccggcggccctgccggtgaacccggcgtggctggccatcctgctctgcggcgcgcccattgtcagggaggcggccgtggggctgttcacccgctttgacatcaaggccgacgtgctggtgtccctggcgctgctcgcctcggtggccattggggagatctttgccgccggcgagatcgccttcatcatgcagcttggctctctgctggaggagcggacggtggccaaggcccgggcgggcatcgaaaagctggtccggctgacgccccgaactgcccggcgggtgaccgccgccggggaggagagcatccccgccgaggccgtggcggtgggggaccggctgcgggtgctccccggagagaccattccggtggacggggtggtgcgggccggacagacctccgtcaaccaggcggtgatgaccggcgagtccctcccggtggacaaggggccgggagacgaggtattcagcggcaccgtcaaccagttcggctcctttgagatggaggccgcccgggtgggggaggacagctccatccagcggatgatccgcctggtgcagtcggcggatgcgggcaaggcgaagatcgtgggcctggccgaccgctgggccacctggatcgtggtcgccgccctcgcttccgcagccctcacgtggctgctcagcggtcaggtgatccgggcggtgaccatcctggtggtgttctgcccctgcgccctggtgctggccacccccaccgctatcatggcggccatcggcaacgccacccgccacagcttcctggtgcgggagggggacgccctggagcggctggcccaggtgggcaaggcggccttcgacaagacgggcaccctgacccgcggcgtgcccgaggtgacggcggtgcgcagcctgtcccccggcgtgacggaggaacaggtctacgcctggctggcccgggcggagctgggctcggagcaccccctgggcaaagcggtggtcagggggtggcaggccgccggaggcgggacgcccgccccggcggaggacttcgaggccctgcccggccggggcctccgggcggtgctggacggccataccgtcctggcaggcagcgaggccctgctggaggaggcgggcgcggcccttcccccggcggccagagcggaggcggagggttttctggcccggggctgcaccctcatctatctggcggtggacggagcccccgccggcttctgcgccctggcggacacggtgcggggagaggcggcggccatgctccgggccctgagcgcggagggggtgtccccggtgctcctcaccggcgacaacgagaacgccgccgcccacatcgcccggacgctgtccattcgggagtaccgggcgggctgtctgccggaggacaagctcaactggatcgaccgggcccagcaggcgggcgtccggatctgcatggtgggcgacggcatcaacgacgcccccgccctgaaaagggcctttgtgggcatcgccatggggggcgtgggcagtgatatcgccgtggacgccgccgacatcgttctggtgaacgaccgggtggaggagctgccccacctgctggccctgtcccggcggatgatgaccaccatccgcctcaacctggccttctctatggccctcaacctagtggccatcgtgctggccatgaccggcgtcctcaaccccgtggtgggggccctggttcacaacgccggctccgtgctggtgatcctcaactccgccctgctgctgaaatggaggagaaggagctgacgccgcggggagcatggagcatatggaaaaacagagccgccgccccgactggggcggcggctctgtgctgctatccgacggtgccctgtatggcgctctcggccagggccagatcatccttgtgcacatataccgtgtactcgaagggggctgcgccggcccccagatggagggctgggccggaggttccatagccggagaatccgcccaccgggcggctgtcctgggtgatgacaaactccaccccggcatcctggagggcggcgcggagctgtccgacctcctgggcgttgaaggtgttgcagagcctgcggcgggcgaggaggggaatcgtggacatgacggcacgctcctttcgataaaaagagacctcttccgacggccgcccacgggcatttttcagttgagggtgccctgaagggcggcctgggccagctcaaagtcgtcctcatggacataaataatgtattcaacggagggggggaccaactgcaggccgatgccgaaaaaggaaccgttctggcggtcctgctggatgacaaactccacccccgcgccctggagggcggcgcggagctgtccgacctcctgggcattgaaggtgctgcagagcctgcggcgggcaaagaatgggatactggacataacggcgcactcctttccacagaaaaggccttgtttccaaccgacgcccgcagggcggccccccaaccgcgagcccaacaacgtgggtcgcggttggaggcgaagaaccgcccggcccggctaagaggtttcgccatcccggcggaacctcgtgccaaaagggcggttctgagcccgtggcgggggcgggtgcgaatcgaacacaccaggacgggagcgccgtccccgtcggttttgaagaccggggggcccaccagcggcccttccgcccccatatccactcccatcatagctggttttccaccgcgggtcaagcagatgtggaaaaaatccggccctctccctgccggcgggtgacgccggaggcgtcccagtgctccagcaggagcagggcgcaccggcgggaacagcccagggcatccctggcctcggccagggaaaagggggcggggccgaagcgcccgcgcagccgggcctccgccgcccggacggccccggcgtggagcagatggccgggggagagctccagcaggacgccccgctccttcaggcggcggcaggcccgccgcgcctccctgatccgcccggcaaagcggggctccacccgcgcccaggggggcggctccaggccgtaccccagatagagggcctccagctccccctccgcctccgccgacggggcgggggccgccggagccgccggggcggcgggggattccgccgccaggaggggccgcccctccgccagggcggccagccgggccagccgctccggccgcatgcggcccttgccggggggcgccagatccaccagcacgccgcctcccaccgtggccaggggggagaagaagcgcgccacaaaccggtcgccgggggcggcggcggcgggctgggtgaagcggagctgggcccaccccgcctcgccggggcggagcacgtcctgtcccaggaggatgcagcggcacaccagggcgcgggcgccgtggtggaagtggagctgacttccggtgtgcacgggaaagggggcgtcggggagcacccgcagggatacgtcggtccggtcggtgagggcgagggcgccgggcgcagccagggtgtccccccggcccacgtcccgcaggcgcacccccgccaggttcaccgccgcccgcaccccggcgggcagcgcctccgccgggacgccgtggcactgaaggccccgtacccgggcggtctgccctcccggatagagctgcaccctgtccccccggcggagggggccgccggtgagggtgccggtgaccaccgtgccgctgccgtccacggagaagacccggtccacgtggagccgggggctgccctccggcgggggcggtgcctgccgggccatggccgccagggcggcccgcagcgcctccagcccctcgccggtgacggcggagacgaagatccggggggctccctccagaaaggtgcctgccgtcagggcacgggtgcgcgcctccacctccgccctggcggcgggggaggccagatccgcccgggtgagggcgaccaccccccgctccaggcccagcagggagagaatgtccaggtgctccgccgtctggggcatagggccctcgtcggcggccacggtaaagagcgcgccgtccagcccgccgcagccggagagcatggtggggatgaactgggcgtggccgggcacgtccaccagggagacccgccccactcccggcagctccaggggggcgaaccccagctcgatggtgaggccccggcggcgctcctcggccagccggtcggtgtccaccccggtgagggcccgcaccagggcggtcttgccgtggtccacatggcctgcggtgcagaagatcatgccctctcctccctccacgccgccagggcggcggcgatctccgcctcgtcgccgggcaggagggtgcgcacgtccagcaggagcttcccccggtggatgcggcccaggatgggcacccgccaggcgcggaggtgggcctccagcgcctccgccggctccagggccgccgcccaggcgggcaggctctcccccggccgggcgccgccccccacttccccctgggtctccaccgccgtgcaggggtggaggggggagagggcttcggccagggcctccgcccgccgccgcagctcctccggcggggcggagagcatggcggacaccggcaccgccgtcccgtcccgccagtccagcagggtggcctccagggcggccagggccagcttgccggggcgcagggcgcggaagagggggtcggcccgcagacggccgagctgctccgccttccccagcaaaatccccgcctggggcccgcccagcagcttgtccccggagaagcagcacacatcggcccacgcaaccgcctcggccagctccggggagccaggggcggcggagcccaggtcgcagaacagcggcaccccccgcttccgggccagagcgcccagctcgggcagggagaccgcctgggtgaagcccacaacccggaagttgctggggtgcaccttgagcagcacctgggcctcccccgcatccagggcggcggcgtagtcggccgggcgggtcttgttggtggtgcccacctccaccagccgggccccgctgcgggccaggatgtcgggcacccggaagcccccgccgatctccaccagctccccccgggagatggccaccccccgccccgccgccagggcggagaggaggagaaacacggcggcggcgttgttgttgaccaccagggccgcctccgcgccggtgagggcgcacaggagggactcgacggccgccccccggcggccccggcggcgggcggagaggtcgtactccaggttggaatagccccgggcggcctctcccaccgccgccgccgcccgcggactgagaggggcccggcccaggttggtgtggagcaccacgccggtggcgttgatcacccgccccagggcgggccgggccagctccgcgccccggcggaggacggactgctccagctcatccaggccggggacggcagacagcgccccggcccgcagggcggcgcggtactcgtccagcacctggcgggccgcctgccgccgcagggcgtagggcagggggctgcccgccagggcggggcgggcgagaagcagatccattttgggcagcgcacgcagcagttccggcttcacagagatccctcccgggtgtcatttggctagagtatatcacattttttcagacgatggggtataaactgcatggttttcagaaaaacgggtacaaaatacggtaagacaaggaaacattttcattgacaggacacttaccaaacggttatgattggagaggtcaaaaagcaaccgattccggcctgccccgcctcggggccgggccgatacagaaagggacagagagcagatgagaggtgtcgaaacccgtatccaggagatccgccaccgggtgttccgggaggtggcccgcatggcttaccacacggagtggccggtggacaagcgcattgagagcctgccttacaagatcatcccgggcgaggtgggcaacttccgcaacgacgtgtttttggagcgggccatcgtgggcgagcggctgcggctggccatgggcctgccctgccggagcgcggcggagcacgccccgctctcggagaatatcgaggcggccgaccggccggagacctactacacccctccgctcatcaacgtcattaagtttgcctgcaacggctgcgcggagaagcgggtgctggtgaccgagggctgccagggctgcctggcccacccctgcgaggaggtctgccccaaggacgccatcaagctggaccgctacaacggccgctcccacatcgaccccggcaagtgcatcaactgcggccgctgcgccgacgtgtgctcctacaaggccattatcattcaggagcggccctgcgccgtggcctgcggaatggacgccattggaaccgacgccaatggcaaggccgagatcgacccggacaagtgcgtctcctgcggcatgtgcctggtaaactgccccttcggcgccattgccgacaagtcccagatcttccaggtcatccgggccatccagtccggcgagcgggtttacgccgcggtggcccccgccttcgtgggccagttcggccccaaggtgacccccggcaagctccgcgccgccgtgaagcagctcggctttgccgatgtctttgaggtggccatcggcgccgacctctgtgccacacaggaggcggaggacttcgtccgggaggtgccggaggagctgcccttcatgggcacgtcctgctgcccggcgtggtcggtcatggccaagaagctccaccccgaccacgcccactgcatctccatggccctcacccccatgaccctcaccgcccgcctcatcaagcacgagcatcccaacgccaaggtggtgttcatcggcccctgcgcggccaagaagctggaggccatgcgcaagagcgtgcgcagcgaggtggacttcgtgctcacctttgaggagatggcggggatctttgcggccaagcatgtggatctgaccaccatcgaggaggatccggacggcgtcaacgatgcctctaccgacgggcgcagcttcgccgtgggcggcggcgtggccaaggcagtggtcaacgttatccagcaccgctaccccggccgggaggtcaaggtgaccagctcccagggcctgcgggagtgccgcaagatgatgcaggaggcggtggcaggcaagtaccccggctatctgctggagggcatggcctgtcccggcggctgcgtggccggcgccggtaccatgcagcccatcaagaagtcccaggccgccgttggcctttacgcccggcaggccaagcacaagacctccgacgaaaccgagcacatcaaggagctggacaagctggtggactgagcagagcaaaacgaacccccggaaccgacgcggttccgggggttcgtttattccttgcaggccagacgcttgtgcacatcccggcggagcagggcgtagagcaccgaggccacgggcacgctgagcagcacgcccaccaggccgcccacgccgccgccgatggtgacggcggccagcacccagatgccgggcaggccgatggaggtgcccaccaccttggggtagatgacgttgccctcaatctgctggagcaccaccaggaagaccaggaagaccagggctttgatgggggagaccatcaccagcagcagggcggacacaatggccccgatgtaggcgcccgccaccgggatgatggcggaggcgccgatgatgacgccgataagaggggcgtagtcggcctggatgaagagcatccccgccgcgcacagcccgcccaggatacaggcctcaatgagctgcccggtgacgaagcgggtgaaggtgtcggccgtcaggtggaccacatcggtgagggggtcggcaaaccgggcgggcacataggcccgcagcacccggcggcactggctcatgagggtgtccctgccggagagcatatagatggagaatactagggagagcaccccggtgaccaccatggagacgatgccgctggtgagctccagcaggtgggggcccaggtcggacaggaagcccagcacgtagttgaacaggtttttgagcacatcgttcaggccggacaggtccagcgcctccacatccaggtggaagtaggcgatgatatcgttgtaccagccctggacgttggccaggtagccccccaggttgagggcgaaggtctggatgctctccaccagcttgggcaccacaaaggaaaagatggcggcgatggccagaatcagcaccagataggaggtgaccaccgccagggggcgggccgcccccctggcccgggtgcgggacagccctcgatcatagaggcggaaaaagaagtggcagggccggttgaggacgaaggccagtgcgaagccgatgagcagcggcttaaccagccccagcacccatgccaccccgccggcgatcaggcccaggcggctgagtaccatcaccagtaccaccgtataggtgatgaggagcagaatgcttttaaacagctttttatccatgctatctcccaatttcatataatctgcctccactatagcattggcgggcggggccagtcaacggaatccgggcgatttaagcaaagtttaatgaaatgttccgcctccataaaaatttccttgacaaagtggcctggcaggcctataatcatagtaaacatataggaattaagaagttttgaaaggagcgtctctatgtcgcacttcatttacgccgaccatgcggccaccacggctgtctccgataccgccctccaggccatgctcccccacttcaccacggcctacggcaacccctccagcctgtaccgctttgcccaggagggcaagaccgacctggagcgggcgcgggcggagatcgccgcctgcctcaacgcccggccggaggagatctacttcacctccggcggtacggaggcggacaactgggccctgcggggggtggccgagctcatggccctgaaggggcggaagggcggccacatcatcacctccgccatcgagcaccacgccgtcctccacaccgcccagtatctggagaagcagggctatgaggtcacctacctgccggtggacgggcgggggctggtggatcccgccgccctggagggggcgatccggccggacaccattcttatctccatcatggccgccaacaacgagatcggcaccatagagcctgtcgccgagctgggccgcatcgcccgggcccacaaggtgctctttcacaccgacgcggtgcaggccgtgggccatatccccgtggacgtggaagcgtggaatgtggatctgctctccctgtccgcccacaagttccgcggccccaagggagtgggcgccctgtacgtgaaaaagcccctgcgcctgcccgcgctcatccagggcggcggccaggagaagggccgccgctccggcaccgagaacgtccccggcgcggtgggtatggccgccgccctgcgggaggcggtggacggcctgagccgggagtccccccgcctggccgccctgcgggacaggctcatcgacggcctgaccgggcttccctacacccgcctcaccggcgacccggtgaaccgcctgcccggcaccgcctcctttgtctttgaaggggtggagggagaggccctgctgctccacctggacgccaggggcatctgcgcctcctccggctcggcctgttcttctgcgtccctggacccctcccacgtgctgctggccatcggcctgccccacgccattgcccacggctccctgcggctctccctgggcgcggagaataccgaggcggacgtggactacattttgaaggaagtgccccaggtggtggcgtatctccgggagctgtcccccgtatgggaccgggacgcacagaagcccacctgggagctgtaactggaaaggagaaactgctatgctgtattccgataaggtgatggaccacttcgagcacccccgcaacgtgggtgagattgcgaacgccgacggggtgggccaggtgggcaaccccaagtgcggcgacatcatgaagatgtacctgaagatcgacggggacgtgatcaccgacgtgaagttcaagacctttggctgcggctcggccatcgccacctcctccatggccaccgagatgatcaagggaaagaccatcgcggaggccatgaccctgaccaacgccgccgtggcggaggctctggacggcctgcccgcctacaagatgcactgctccgttctggcggaggaggccatcaaggccgccctggccgactactaccgccgccagggccgggaggtgcccgaagccctccgcctgccctgtgaggatgaggagcacggctgctgctcctgcggccactgagccaggacacgcaaggccccggaatcgaagcggttccggggcttttttcttgacagagggcggggcttgtcataaaataggacggaactttgtgagaaataagggagtatgggtccgtgatcgagttaaaacacatttccaagacctttcccacggccgacggcgtgtttcaagccctggacgacatcaatctgaccatccgggacggggacatcttcggcatcgtgggcatgagcggcgcgggcaagtccaccctggtgcgctgcatcaacctgctggagcgccctacagcgggccaggtggtcatcgacggacaggatctcatggagctgtccgccccccagctgcgggagaagcgccgctccatcagcatgatcttccagcagttcaacctgctcatgcagcgcacctgcctgggcaacatctgcttccccatggagatcgccggggtgcccaagggggaggcgcgcaagcgcgccctggagtatctggacatcgtgggcctgcccgacaaggccaacgcctacccggcccagctctccggcggccagaagcagcgcatcgccatcgcccgcgccctggcctccaatcccaaggtgctgctgtgcgacgaggccacctccgccctggaccccaccaccacccgcagcatcctcaggctgatccaggacatcaaccggcgcatgggcatcaccgccgtgatcattacccacgagatggcggtggtggaggagatctgctcccacgtggccatcctggagcgcggccgcatggtggagaccggcacagtggaggcggtgttctccaaccctcagaccgaggcaggccgccggctggtgttcccggagggggccaacatcgacaagtttcccgtggcgggcgtggtgcgggtggtgttcaacggcggctcctcctacgagcccctcatcgcctccctggccatcgactgcggcgtgaaggtgaacatactgggggccgacacccgcaacgtaaacggcaaggccttcggctccatgctgctgggcctgcccgaggatcatggagaggctgtccgtgccatgaactatctgaaggcccagaaggacgtcaccgtggaggaggtgcccgactaccatggataaatttatgcagcagatgcgcgaggcctttgccaacgaggccctgtggaaggagttccagactggtatctgggacaccatctactccaccgtggcggccactctggtggcctgcgtcctgggcattatcctgggcattatcctggtggcgggggaggaggacggcgtgcgccccctgcccggcccggtgatgaaggtgctcaactttgccatcaacatcctgcgctcggtgcctttcctgatcctgatgatcatggtgcttcccctgagtgagctcctggtgggtaccaccatcggcactgtggcctccatccctcccctgattatcgcctcggcctccttcgtggcccggctggtggagacctccctgcgggaggtggacaagggggtcatcgaggccgcccagtccatgggctgctcccccttccagatcatctggaaggtgattttgccggagagcctgccctccctggtggccagcttcaccaccgcatttatcaccattctgggctacggcgccatggctggcgccatcggcggcggcggcctgggcaagattgccatcaactacggctattataaatacaactatgcggtgatgctcatcgccgtggtctttattgtggttttggtgcagattttccagtcactgggtacctccctggccacccggacggaccaccgcatcaccaaccgggctgggcgaagaaagctccgccggaacgtcagccggcagatgaaccgggacaagcgcagccccggcggcatgtgaattttggagggggcggcaaagcagttgctttgccgccccctcttttttgtgcagaatatgcgattgacaggagcgccttccggttgtaaactaagtgcaacccaagcggaactgaataacgcccctcaaacgcgaggaagagaagagtagccagagagatacggcacagagagcccggaatggtggaaacgggtacggaaggctttggggaagatggtctcggagcggcgcggctgactgccacaggcacaggccgcgacgggagcgcccgtcagcgcgcgggagtatgccagtactccataaggcccctgtcgtgaggcaggggtgaagcaaggtggtaccacgaagccggaaggctctcgtccttgaatttggattcaagggcgtttttttgtgctctgatttgggaataccacctccctttgaggaacaatgaaaaggagaaatgcaccatgaagaagctcgcatccctgctcctgtccggcgccctggccctcggcctgctggccggctgcggcggcacccccggtaccgccgacacccccgccgcaaacactgacacccctgccgcccccacccagaccggctccctggagggcaccaccctgaaggtgggcgcctctcccgctccccacgccgagatcctggccgtggtgaaggaactgctggcggaggagggaatcaacctggagatcgtggagtttaccgactacatccagcccaacaccgcggtggagaacggcagcattgacgccaactacttccagcacatcacctatctgaacaacttcaacgctgagaatggcacccacctggtgagcgtggcagatgtgcactacgagcccttcggcatctacgccggcaagaccgccagcctggaggagctccaggacggcgcgcagatcggcgtgcccaacgaccccaccaacggcggccgcgccctgctgctcctccaggagcagggcctcatcactttgaaggaggatgtgggcctggagcccaccaagctggacatcgcggagaacccccacaactatgagatcgtggagatggaggccgcccagctcccccgctccctgggcagcctggacattgccgtcatcaacggcaactacgccatccaggccgatctgaaggtggccgacgccctggcgattgagtccgccgagggcaccgccggcaccgcttatgtcaatgtgctggccgtcaaggagggccgggagagcgaccccgccatccaggctctggcaaaggccctgtgcagcgacgaggtcaaggcgttcattgacgagacctatgccggcgccgtgcaggcggtgttctaaggtcctgtccacacagacggcccgctttgcgggccgtctcatccgactaaaatcctattgattttgtaggaatttggtggtatactgctgaatagaatctaaattatgagggaggtattacctatgcagattgcaaatacactgcccgagctgatcgggaacacccccctgcttcggctggagcggtttgcccccggggcaggggtgctggccaagctggagagctttaaccccctgtcctccgccaaggaccgggcaggcctttacatgattttggacgccgaggagaggggcctgctccagcccggcgcggtgattgtggagcccaccagcggcaacaccggcgtggccctggcctacatcggccgccagcggggctaccgggtggtgctcaccatgccggagaccatgagtcaggagcggcgcagcctgctggccgctctgggggcggagctggtgctcaccgaaggggcccggggtatgggcggcgccattgagcgggcgaaggagctgctggagagcaccccaggcgcgtggatgcccgaccagttcaacaaccccgccaacgcccgggcccactacgagaccaccggtcccgagctgtggcgggacaccgacggcggcgtggacgtgctggtggcgggagtgggttccggcggcaccatcactggcgcgggccgctatctgaaggagcagaaccccgccatccgcgtggtggcggtggagccggctgagtcccccgtcctctccggcggccggccggggccccataagatccagggcatcggcgcgggcttcgtccccggcaccctggacatgggggtggtggacgaggtggtggccgtcaccggcgacgaggcctatgccgccgcccgggagctggcccgtaccgagggggtgttggccggggtgtcctccggcgcggcggcccacgcggcccgcatcctggcccagcggccggacatgcggggcaagaccatcgcggtggtgctccccgatactggcgagcgctacctctctacagggctgtttgcgtgaatagagcgcggtggacacaatcggcagcatggctccggccgcaggcgttttgcctgtggccggagccatattatgtatggagctgggcctccagggcggcacggtcggggagcagatagtgctggcgcgtctttttcagcaggccctcccggctcaggctttgaaagcactgggacaccaccacccgggagatgcccagaaaatcggccacctcctggtgggtcagccggatagtgaggcggacccccgccccctcctctgtaccgtatggctctgacacggagagcaggaactgaatgacacgcccccgcacgcttagaaagctgtcgcggatcagcatgcggccaagcacctggctcttccgggcggagatctggaacagcttcagtgccagggcgggagaggcctcggcccgccgtttgaacacctccgccgggatgcggaaaatctgacacgcagtgactgcgacggcccggtattcccgcgggccgccgaacaggcactcgtcctctcccacgggaatcccttcaaagagcaggcagagcacccgctttttcccgctgctgtggatgcactccacccggatctgccctgtttgcagaaaaatcacctcgcgggccgggtcgccctgctgatagaacaccgtgcccgccgggacggtctccgggcgaaagccgtcggtcagtctgtcccacacggtgtcccacggttcatttccaacggcggagaggtgctccggaatccactgcttttcccagcgaagctctttttccaatggtgttcacccttctcccggtttctgcgcgcgcagcccccgcacagattgggaggcggttcgtgcggtttgcacatggatacccaatttattttctttattttcgaagaaaatgacgattttgtaaagtggttaacagaaaattgcggcggggttttctatactgtatcacgttgtgcggcccgcacgctgtggggcctgtcaaatctggtaaaatggaaagggatggagcgaatgaaacgaaggacagcgcacgccctgtgcgcagcgggcctaagcctgtcactgctggccggcttggtgccggccatggccgcaggcccggcggaggtggcggatagcctctacatcaacggcaacatctacaccgtggatgaagacttctccactgccaccactatggcggtgaagggggaccgcatcctgtatgtgggcgaccaagccggtgcggaggcctatgtgggtgcgggaactgagatcaccgacctcggcggcaaaaccgtgctgcccggtctcatcgagggacatatgcatgtcagcaatctgggggaaaaccacctgaagctggactgctactttaaatcgaaggaggatattctggagatggtgcgccaggccgccaaggaggcggagcccggcgagtggatccagggttccggctggctggataccctgtgggatgagcccggcttcccttcaaaggaggaactggacgccgtggcgcccaacaacccggtctatctgctccgggcagacaaccatatgggctggtttaacagcatggcgctggagatggcgggcattaccaaggataccccagagcctcagggcggccagattctcaaaacggacaacggggaactgctgggctgccttaccgacaacgcggcgtcaatggtcatcaaggtaattcctacctggagtgctgaggcacagaaaaacgctgtgctcatggctcaggaggagctgttctcctatggctttacctctgccacggacgcaggcacaaaggtcaactacatccagcactatgaggatctctatgagagcggtgagctgaagctgcgcatttacgccatgcccatgctcaacagcacggacagcgccgaggccggctacatccgggagcaccggccggtcaacggcctgtacgacaaccatctgagtataatgggtgtcaaggtgctgggcgacggtgctctgggctcccgcggctctgctctgctgaaggattactccgacgatccgggcaatcgtggttcctaccgctttacggacgaggagatttacaacgtgatgagcctggcctacaacaacggctatcagatcgcgtaccacgccatcggcgacggtgccaaccaccaggtgctgaacacctacgagcgcctgctgaaggaaaatccccgggaggacccccgcctgcgcattgagcacttccaggtcgttaccccggaggatattgaccgggccctggagctcggcatcctcaccgcgatgcagtttacccatgccacctcggacctgtccatggcggaggaccgcctgggccccgagcgtattcagacggcctacgcctggcgcaccgttctggataagggcggcatcattatcggcggctctgacgcgccggtggagatggtcaaccccttccacggcctgtatgccggtgtcacccgtatgacccgcgccggtgagccggagggcggctggtacgccaaccagaaggtcacccgtgaggaggcgctgcgcgcctttaccatctgggccgcctatggtcagtttgaggaggatctcaagggctctctggagcccggcaagctggccgactttgtagtgatcgaccgggactacatgacctgtcctgaggaggagatcaaggatattcaggccctgatgacagtctccggcggcgaggtggtctataccaaggacaccagcgagcctacgattctctggcaggggaagccggttaccctcctgtctggggcgctgattgagcagcccggcaccatttatgcctccgcctcggatctggcgggcaacatcagcgcggttctggagcggggagagggcactgtgaccgtgacctgcggtgagcagtcggcggagcttcccgtcaagacggtgaatggggcagactacgtccctgttcgtgccttctttgaaggcatcggctatgcggtgacctggtgcccggacagccggacggtatcaacctcccgcatgagcacggcggacacctctgaggctgcggctcagccccctgtggacgagtacagctttcagctcggcaattttgacggcaccgtgggcgccttctgcgatgtaatcatgaccggagccaaggagctggcgttcagtgatccctttgatcccgaggacgaaccccttcttacatcctatgtggcgaaaaagtgcgagggatacggtgtaaagtactacatcgacaaggatcttcttctgaccaagctgttttccactgtggagatggatggtcagtgggtctatatcctctatgccgacgacgcagtgcttcaggagtatctggagctgaagcaggaggagaaagacatgattgcagcaggaacctacacagagaaggcccagatcgacctggctacccggtatggcaagctgatgggctatagcgatgctcatattgctgccagcatcgcaggggcgtaatccagacaatcagagccgccgcactggaaatcagtacggcggctctgatttattttgggctgttctacgcgttatgtccggggcacttctcatgatagcggcgcacgaggtcggccagagtcaggcggtccaccacgctggagacggcggcctgaatgtcccgccacacctctacggtgacgcaccggtcggcccggttgcagcggcaggtatcgtcctgatccacacagctcaccggcgccagattgccctccagcacccgcagaatctcccccacggtgtactcctctggctcacgggtgaggaggtagccgccccccgcgccccggaccgagcgaaccagcccggcccgggagagctgagttacaatctgctccagatatttatcggaaatctcctgccgctgggccacatcccgcagcggaactgccgcgccatggctgtgaagggccacatccagcatgaggcggagcgcataacggcctttcgtggaaattttcatgcacatccctaccttttctgacaaatataataccatggaacaggtaggatttcaagtgaaatttccacttgactttcgcgccaaaaagtgctaaagtgctctacaagaggagcgtgagaggttcatgcgcaggtacgtcggttatggatacggctattaccgctgctattttgccagcggtctgtttgcctgcccataaccggcctgtcaggaatcttccggcgctccgcagttggagccgatggaacccgcggccgcctttgggcggctgcgggttctttgtttgtgaaaggagtcagaatatggttgtcattatgaagcgggagtttaccccggagcagttggaggccgccgtacacaccatggaggagggcggcgtcaaagtcatggtgtccaagggggcggagaccaccatcctgggcgcggagggcaacgccgagcacatcgaccaggagaagctgtccctgctgcccggcgtggagcgggtcatgcgggtcacggagccctataagaaggccaaccggaagtaccacccggaggacacggtgattgagctgtccaatggccgcagcgtgggcgggaaccggctggcggtgatcgccgggccctgctcggtggagagcgaggcgcagattgtgggggtggcccaggcggtaaaggccagcggcgccgccgccctgcggggcggcgccttcaagccccgcacctccccctatgccttccagggtatgggcaacgacggcatccgcctgctccaggaggcaaaggaggccaccggcctgcccatcgtcaccgagatcatgtccaccgacaacgtggagatgttcgagatgtgcgtggacgtgattcaggtgggagcccggaacatgcagaacttcgacctgctcaagcaacttggcaagacctccaagcccatcctgctcaagcggggcctgtcctccaccattgaggagtggctcatgagcgccgagtacatcatggccgggggcaaccaccgggtcatcctctgcgagcggggtatccgcacctttgagacctatacccgcaacaccctggacctctccgccgtgctggcggtgaagcagctctcccacctgccggtggtggtggacccctcccacgcctgcggcaaggcgtggatggtggagcgcatgagtctggcggcggtagccgccggggcggacggcctcatcatcgaggtgcacaacgacccgccccacgccctctgtgacggggcccagtccatcaccccggcccagtttgacaccctcatgggcaggctgaccgccctggccccctgcgtggggcgggagctgtgaccggccctcagtaaagaagaggagtgcgcgatgaaacaaacgatgctgattgtgggcctcggtttaattggcggctcactggcccttgccctgaagggctttgaggatttcgagattgtgggcgtggacgtgtcccagcccaccctgcgctacgccgccgagcacggtgtgggcgaccgtgtgaccgaggacgccgccgccgagctcccccaggccgacgtggtggccctggccctccacccccaggggatcgtggacttcctggcccggtatcgggatgcgttcaagccgggggccctggtgtgggacgtgtgcggcgtcaagaccgctattttggaggcggcccaggtgctgcccggtacagtggattttatcggctgccaccccatggcgggcaccgagttctccggcgtggagcacgcctttgcggagatgttccgggactcccacttcctgctggtgccccgggatgacagcaggccggagcacattgccctgctggagcggctggcggcctatatcggctgcaaggacgtatgccgcaccaccgcccaggcccacgacgccctgatcgcctacaccagccagatgatgcaccttatcgccgtgtcggtgtgcgacgatccggagctctttcagtgcaggggcttcgagggctcctccttccggggctgtacccgggtggcggccctggacgtggggttgtggacacagctcttctccctcaaccagcccgccctgctggcggcggtggaccggctgctggacaacctccagtcctaccgggacgcgctggcctccggaaaccgggcggccctggcggagaagctggcccactccgccgcccgcaagcgggagatggatctgcccgggcccgatctgctggcatgacaaaaaggcgccgctgcattgcagcggcgcctttttgtcacggcttctgaaaaatgttgagatccgccgcggtgagcggcgcgttgtaggggttgatgagggagttgacggtctccagggcggcctccgggtccagctcgtagcaggagccccagcggtagccccggctgtccacatagtagacattctcacccgccagggtggcgctggcaaagcccgtggagaagtccaggcccagggcgggctgggcaaaccagagggcctcgctgaactccagatcagtgtccacatactccaggaagaggttcacgtaagagttgatcttctgcggattggacagggcttttttcaggatggcggcgatgagctgctgctgggtgcgggtgcggccgatgtctccgtccggataggcgccgtacaggttgtcggggtaggagccggggccgtcggagttgttgcggcagcgggccaccttgagcacgtcctcgccggtcaggtgctggaggccgggctggtagtggatgtggaggtcctgggtgggatcgtcaaagctcatgcgcaccggtacgtcgaactcgatgccgcccagctcatccaccagggccacaaagccgtccacgtccaccgccacatagtagtcgatgggcacgcccagcaggttagagacggtgtcccgcaggttctccggccccttgtggtaggcggcgttgatcttcccgctctccagcagggtgtcccgggggacggagaccatacccaccttctgagcctcagtgtcgtaggaggccacaatgatggtgtcggcgttgccgctggactggtcgctggcggccagcagaaaagtgtatgtcccttcccgcctctggcggccaggcgcttcggtctgatccggggagagggagccggcgggggcctccggtgtgggctccggggcctgggtgggctttttggaggccaggcgataggcgcagtagagtaccacgatgatggcggacaggaccaccaggatgcgatatgccagcttccccgcccggcggaggggggagacacgcttttttttgcggatgcgacggcgttgggccacagagaggcgcccccttttctcaggtgtgattatgtcaacaagcaaccactagtatataaaatgggaagccgtctgacaagagaaagtttgcaaacttcacgaatctgtaagaactcagaggcggctctggatactcagggttgcggcggtgagcgcgttgacggcccccagcagctccaccagaagctgattttggcaggccagggcctccagaatccggtccagcccgtcggcgggcggcggggtaggacagtcgatgcagtaggggatgggatgggcgtagcgcttcatgggctcctcctccagaggggcgccctccagccgctggcgggccatccggcggccctgggcgatgatggcctgggcctgggactcggcctgggcccgggcatcccggccgggctgacggcagtttgacatggcagttacctcctttttaccccattctatggaaaagcagccccatttgcgcttgacatttggaaaatacgtgctacactaaactgtaccgtatgagacagatttgggggagggagagccaatggacagccgggaagcggccgagcgggcccgattggcggagacctttctcttccggggtgcgccgccggaggcggtggagctcgcccggaccgacccccgcacactccggcaggagaacggtaagggcggggtgatttacgcccctcacgccttccgccgctgcctgggcgtggtgctggagggccgggtgcaggtgaacaagggcgcgctcatcatgagcgtgctggaaccgggggatctcttcggcgcggcggccctgttcaacgaccgggcggactacgccaccaccctcaccgcccgcgcgccctgccgggtgctccttctgccccaggcgctggtggaggagctgatggtccgctttccggaggtggggcgcaactatgtggcctacctgtccggccgcatctgctttctcagcggcaagatcgacgccctcaccgccggcagcgccgagcggaaggtggcccagtacctgctctcccggctggaggggggatgggtggagctggactgctctgccgccggcctggcccggcggctgggggtgagccgcgcctccctctaccgcgccctggacgccctggccgggcggggggttctccggcgggagggcagacgggtgcaggtgcttcagccggacgcgctggaacagaattaggaaaggaagagattgacatgaaacagaagctgctgtccctgggcctgagcctggcccttgtgctgggcctggctgcggggtgcgcccccaaggccgggccggaggagtcccccgcgccggagacgtcctcccccgtcgcggaaaccccgccggccgagaccgttgccccttaccagaccatccggctgggcctgctcaacggccccaccggcatgggagcggccaaactgctctccgacagcgacgcgggggagacggtcaaccactatgagtatgccatcggctccgacccgtccaccgacattgtgcccaagctgaacaacggcgagctggacatcgctgcggtccccaccaatctggcggccaccctctacaacaaggcgggcagcatcaggctgctggccctcaacaccctgggcgtgctccacatcctggagaacggcgacacggttcactccatggccgatctggcgggcaagaccatctacagcatcaaccagggcaccaacaccgagtacgtgctcaactatctgctggaggagagcggcctcacccccggcgaggacgtgacaatcgagtggaagaccagcgaggaggtcacggccctcatggcctccggcgggatcgatctgtgcatgctccctgtccccgccgccaccagcgtcatgatgcagaacgccgatgtgcgggacgccatcgatctcaacgacgtgtggcaggaggtgggggccgccggcaccttcaccatgggctgcgtggtggcccggagcgacttcgtggaggagcacccggaggcggtggacgccttcctcaccgagtatgccgcctccatcgcctatgtgaatgagcacccggaggaggccgccgccctggtcgagcagtacggcatcgtccccaaggccgccgtcgccaaggcggccatcccccaggccaacatggtctgtctgaccggcgacgagctgaagggcatctccgactactatgaggtgctctatgccgccgaccccacctcgatcggaggggccatcccggatgataatttctactatattccgtaatcgaaccacacaaaaaatactgcgcgttgtcgtgcccctggccttctggctgggggcttggcagcttgcggccatttgggtggacactgtatatacccccggacatggggccctgctcctgccctctcccctgctggtgtgggagcggctggccgccctggccgcccggccctccttctggcggacagcggcggtgagcctgggccgcatcttcggcggcttcgccctgggggcggcggcgggcaccctgttggccgtcattacctccgccctctcctgggcggactggctgttccggcccatggtgaaggtgatccgcgccgtgccggtggcctccttcatcgtgctggtactcctgtgggcctccacggggcgggtgcccgccatcgtctcggggctgatggtgcttccggtgctgtggggcaatgtatgtaaaggtatcagccagaccgacgggcagctcctggaggcggcgcgggcctaccgcttcggccgctggaagaccctccggctggtgtatgtcccttcggtgctgccctatttcgccagcggctgcgccaccggtctgggcctggcctggaaggcgggggtggccgccgaggtgctctgccagcccaggctggccatcggcacccaggtctaccgggccaagatcaccctggagacccccgatctcttcgcctggacggcggtggtgatcgtcctcagctttctgctggagtacgccctgggcctcctgttccggcggctggggaagggggcaaagctgtgatatcagcggaacatattacggtctgttatggggaaaagcgggtgctggacgacttctccctggtgctgccggagacggggatcaccgccctgtccggcccctccggctgcggcaagaccaccctgctgcgggtgctggcgggcctccagcggcggtcggccggggtggtgacggttcccccccgccccaccctcctgtttcaggagaaccgcctgctgccctggcggacggtggagcagcacatcgccgacgtgctcccccgggcgcgccggggggaggcggggcgctggctggccctggtcgagctggaggaggaggcgcggtcctaccccggcgccctctccggcggcatggggcggcggctggccctggcccgcgccctggcctgcggcggcgggctctacctgctggacgagcccttcaccggcgtggacgccgcccgggcggcccgtattctggaacgggtgcgcgccctgggcgtgccggtgctcctctctagccacgaggcggagattgtcgccctctgcgaccgggtcatccccctcgccggaccgccgctgcacatggcagatccgggctagaagggcggccccggaaccggagggttccggggccgccgccttttaaaacgtcttttgacaggctgctgaactttttgaggcttcaaaaggttgtatgacccaacatgagcggcccagaccggtctcgctcggtctgcggtccattcaccttccgcgccaagcgccgccgcaaagcggcggttgcgctctcaatcgccctgcggggcagcccttcgcgcgcttctcccctccgaatccttcggcagagaggggcggtcgacagcctcgcggcaagtggccggacggggataaatttctgacaaacgggcgaaagcgcattgcgctttcgcccgtttgtgctaaaatggttgtcataatcatttgagagaaggcagcaaacaatacatgacatacaccgtagacaccccgcgcagcaggcggcgcttccgatggccacgcctccccctgggagaagggcaggccgcctggaccacccgggccctaatgctcctggcccccctgctctccttcaccctggtggagtacctcaactacaacaacccctggactgacttcacctcccttcagatcgccctcaatctggcgtggtactacctgggggagctgtttttctacttcgtcctccggcggcgggcctcggccgtcaagtgggccatggggatcgcctggggcctgggcatggccaaccactacctgatctccttccgggggcgcaccctctttcccggcgacttcctcaccctccgcaccgccgccaacgtggcgggcaactacgactaccggcccgactccatgcagtggctcaccatcggcgtgttcgcggcggtgttgctggccctgtccttcctgccgaacgagaagaaaaggcccttcccgtggcggctctttgtcccggcggccggggccgccgcggtctatctgggcgtgtttttcggcaccgggtttgtggagagccggggcattgagccctccatgtggacgacccggggcaacggcctgttccttaacttctcggtgtgcctgaagtacatgagggtggagcagccggagacctactcggaggaggccctcgcggccctcgccgggagcgctcccagcgacccggccgccgtgccggcggccggggaggacggcatgattcgcccggtgaacgtcattgtcatcatgaacgagtccctctccgacctttctgtgctgcccggcgtggagagcaatacggacgccatgcccttcctccgctccctgacggagaacaccattaagggctacgcctactcctccgtgttcggcggcaccaccgccaactcggagtacgagttcctcaccggcaacaccaccgccttcctgcccgcaggcacggtgccctaccagatgtatgtctccgacggcgatcccaccctggtggggcagatggccgccctgggttaccgcaccgtggccgcccacccctaccgctcctccggctggagccgtccctcggtttaccgggatttcggctttgacgaggtatactttgagggggacttccaggaccggaagtacatgcggggggacgaaaaaaccggctatgtcaccgaccagtgcgactacgagaacctgatccgctggtatgaggagaaggaggcgggggagccgctgtttctcttcaacgtgaccatgcagaaccactccgcctaccagatggcgtggacgaacctgccccgggaggtgtggctcaccggggcgctggagggccgcttcaacacggtcaaccagtatttgtccctggtgtaccagagcgatcaggccttcgaatacctgctcggctacttctcccaggtggaggagcccaccctgatcctcctcttcggcgaccaccagccccaggtggccaccaacttctataccgacgtgctggggacggccccggataccgccctggcccagaaaaaacagatggtgcccttcgtcctctgggccaactacgacataccggaggcccagggggtggagctgtccctcaactacctgtccgccctgctgatggacaccgccaacctgcccatgaccgggtatcagaagtacctggcccggctgtgggaggccgccccggtgatcaacaccgtgggcatccgggacgccggcgggaactggtacggcgagaacgaggcgctgccggaggagctggaggccgccgtggaggactaccgggtgctgctctacaaccatgtatttgacaagaaaaaccgggtggaggggttcttcacgctgacggagtgacacccgtatcccgcccaaatcaaacgcagccgcaggccgcccagtctcactagagactgggcggcctgttgaatgagaagataaaatgcaggggcgggtaatgcgcaagaggcgccgggcctggcacagcgggccggtgtgggcatcggcccgtgcggtgtgggaatgaaaacgcaggggcggccacaggggccgcccctgctcagggcgcgggaaatgccgcccggcggcggtcaggccgaacggggcctcagtacagccccagcagatagcggaaggcgaaccgcttccaccaggggagggacttgtccaccgcctctgccgcggcgcgggcggcgcggagcaccgcgtcccgctcctcggcggtgagggtgtgggggctgaatttggccttttgggccagctccccggcccgggcgggcggctccgctccccagcgggtcagccgctgaagatagagataggccgcgatggccgcccggttggggttttcatcctggaaacgccgctcccggcggcggcgggcccaaaagcgccgcagggggagggccagcgccagcagaagggcggccaggagggccggaagcaggcggagagggagcttcgggccctcattcgggagggccgccgacggcgtgggggtgggtgtaggcgcggcggagtcgggggcgcggctggcctggggcgtgggcgtgggagagggggtggcctcgggctcctccgcgccgctctggccgggagtgctcccggcgtagacgggggtgacctccaccggctcccacccgtagccgtcgatgtagacctccacccaggcgtgggcggcggagtcgggcacgttcacgcggccggaggcgggcacgtcggccacaaagccggagacatagcgggcggggacgcccatgctccgcagcagcagcacggcggcgctggcaaagtgcatgcagtagccccgatggctctcggtgaggaaccaggccacaaagtcctccccctccggcgcggcgggggtgtcggggtcgtattccgcgacggcggctaggtagtccgccaccacctgggcggcttccagcgcatagggctgcttcacagaggcgggggaggcgtactgggcctgccgcagccagtcggccagcggctccaacgcgccgtccagcgcctggcggagcgccgggttttccgagtagagggggacctggaggtagtactcccgcacgaagtccgcgtaggccgcctccgccagagacagctccccccgcaggcccgcggaggcggcgggggaggcgtcgggctggacgtagatggtgtgggtccacacccgggccgcccgggccagataggcgtcgtggacgaattccgccccggacagctcgccgggctgggtcaggatatggtagggaacgtagacatagcccggatcagcccccacattgcgcacggtgatcctggcgtaggggctctccgggtgggcatcccgaaccgccagggcggggaaattcatgggctggaactgggcgaacagggactcagccccagtggcgccaaggtccatgtccagcgtgacgggcgctccgtatgtgacgctgcggaggcgggcctgccagttgtaggccgcctcatccagcggctgccagctctcgccgtcatataccgcgtcggagagcccccgcaggtagatgcggccagtgaggtcggtctccacctccagcacggtgcgtccggagaagcgcagcggccccgcgtcggagagagagacggagccgtcggcgtcggccagccgtcccccgccgctgccaatgccgaaggggccgctcccctccagcaggccgtcccccaggcggacggcctgattggtgaggtgctgcagggcccggtcggcccaggcggggcgctggtaggtgtccatgggcatggccaggctgagggcggccagcagcagggcggcggccggaagggcggccaggttgaggcgcgcggccccctggggcgaggtgcgggccagcagggaggtgagggccggcaccacccaccccagcaccagggccatcaggggcagccagcctggggtgaccgagatgcacagggggagcagcacgaaggggaaggagctgacgaagaccagccagaaggagcgcaggcgcacgacgcccagccccagcagggcgcccagcggtaccagggccaggaggacgagcagggtggcgcagttggtccagagggcttcggggagtgaaagggcgggctccagggtgaagcccagctccaggctggcggaaacggtgttggccacgtccacccgcagggcgtcggcccctagggccagaggctgccacagccgccgcaccgccaggacccaggcggcggccagcagggccaggggaagggcccaccagcggcgggggagggaccagaggccgaggaaggccagtgcggcggcggcgcagcccagcagcagggggagggcgtgaatctggacggagaaggcggtaaggaaggaaaagacggtgcccgccagcaccagaaggaggaggcagccgtcccccagcaggacggcggggccccgccgcagaggcgcggcggcgcggcgcttgcgcttcatggcgcacctccttccagcccggtgggcgttacatggatgtgccggaggggaccggcgcggccgggcaggcgcagggcggtgtccaggatggagcgtccctccgccggggcgggccgggagaaggccagctccaggcaggccagcagggcccgctccgagtccaccagccgcccctccacgccgccgccggtggggctggcccactggatatggtggggcctgccccgctccagcagggcccgggacagggcgcacagccgggcgaaggtctgatccagcgccgcgggggcgccgaagtggtcataggtgagcaccagggtggtctgccggggctccagggtctcccgcaccaccagctcgtcccgcttggaggagagcttccagtggaccgagcgcagggggtcccccggccggtagtcccgcagatcgtagtcctcccccggccctccccctgggcgggggaggagcgcaccgccgccggggccgccccccagcaggcgctccggcagcgcctgttccatatcgggcggcaggatcagcaccgccgccggccgcccggtggggatgggcagggggaacaggcccagcagatcgcaggtccaggcccgctccgcccggcagaccagccggccgcagtggggggtggtcagctccagagtgggcggagcgcctggtgcggtgcgcacgggctcccaccgcacccgcccgcccgcgccggtgagctggttgctccagtggagacgggcctgaagccggggcaggggcaggcgggtgcggctgcgcagccgcacctgaaagaccgcgtcctccccctgtaccactgtgggagcggcgggggtgagaagcagtgtgcagcccagcaccgacggcaggctcagcagcaccgacagcagggggagcagcagcaccagcgccagggtgaaggtggacaggtagaagcggaacacgatctgaaagagcactgccccgcccagcagggccgcgtaggcaatccgacggtacgccatggcgtcaggagatccggggggcgggcacccgctccagcagctccgaagcggggtcgaaggagcggtcggcctccgcacggggggagaggagcagccggtggggcaccacgtcgccaaagaccagggacacatcctccggcagaacatagtcccggccccgcaccagggcggcggccttggccatggcggtgagggccagggtggcccgggggctggccccctggagaatcatggggtggctccgggtggcgcccaccaggcgtacgatgtagtccagcacctcgtcggatacgtagacctgtccggcctgggcccgcagggcgagcaggccgttgagctccagcaccgggcgcaccccctccaggagtgcgcccccctgccggcggcgtaccatggccatctcgtcggcgggggcggggtagccgatggacaggcgcaccatgaaccggtccatctgggagtcgggcagaagctgggtgccggaggcccccgccgggttctgggtggcgatgaccaggaagggctggggcaccgggtgggacaccccatccaccgtcacctgcccctcctccatagcctccagcagggcggactgggtgcggctggtggcccggttgagctcgtcggccaaaaagaggttgcacagcaccgcgccgggctggtactccatccggcccgcctccttgttgtagagggtgaagcccgtgatgtccgacggcatcacgtcgggggtgaactggacccggttgtaccggaggctcagggccttggagaaggccagggccatggtggtcttgcccacgccgggaatgtcctccagcaggatgtggcccccggccagaatggccagcagcacctttgccagtacctcgtccttgcccaccacggcgcggcgcacctcgcccagaatggcggcggccagcttgctcccctccatggaaacgccctccttatcatctgtcttaccctccattctagcagagctttgatttatgtcaacgaaaaaagagttacagattgggctccgggccaaacaaacgcgcaaaacctcttgcactgcgggatgttttgtgctatagtacatacgatagtaagtagtggtatggtgagagtggggtcgcggctccgctctttcttattgaaaaaacggggtatgtaaaattatgggaaatatcccggaacggaggtcaaaccatggcgaaagtgacggagctggtggccgctctggccgcccccattgccgagcagaacggctgcaccctctgggatgtggagtatgtccgggaggcgggacagtggttcctgcgggtgtatatcgacaagccggaggggatctccatcaacgactgcgaggcggtgagccgtcccctgtccgacgcgctggacgaggccgaccccattgagggcagctatgtgctggaggtgtcctccgccggcgcagaccgccccctgaaaaagccagcccacttccagcagttcctgggcgcggaggtggatgtgcgcctctaccggcccctggacggccgaaaggagtacaccggcgtgctgaagggctatgatggcggcgatgtgaccatcgagaccgcgggcgaggcccgcacctttgtcaaaaaggatgtggcgcaggtgcgcctgacggtgcatttttaaggagagcgggtacgggccgggggcccgtaccgacgatgcaggggcgacctgcggccgcccgcaggagaaataaggagtgcagttatgccgaagaagaatgccaaagcgcagaagtccaacgagctggacggggcggagttctttgccgccatcaacctgattgagaaggagaagggtatccccaaggcctacatgctggagaaaatcacccaggccctggtgtccgcctacaagcgggaccacgagggcgcgggggacaacgtgaccgtggaggccgacgaggaggccggcaccgtgcgcatgttcgtcaagaaggacgtggtggaggaggtcgacaacccctgcaccgagatgagcctccagatggcacgggagaagctgccccacgcccagcttggcgacgtcatccgcatcgaggtgcgcacccgcgatttcggccgcatcgccgcccagactgcccgccaggtgatcatccagggtatgcgggaggccgagcgggggatgatctacgacgagttctcctccaaggagcacgagatcctcaccggcgtggtcacccgcgtcgatccccgctccggcgcggtgagcctgcgcatcggctcgggcagcgaggccaccgaggccttcttggcccccggcgagcaggtcaagggcgaggcgtacctcgaggggatgcgcctgcgcgtctacgtggtggaggtgcgccgctccaccaagggaccccaggtgctcatctcccgcacccaccccggcctggtcaagcgcctgttcgagctggaggtacccgagatctacgacggcaccgtggaggtcaagtccatcgcccgtgaggcgggcagccgcaccaagctggccgtctggtccgccgatcccgacgtggaccccatcggcgcctgcgtgggtccccggggccagcgggtcaacaacatcgtggaggagctcaagggcgagaaggtggatatcatcaagtggtccgaggagccggcggagtacattgccgccgccctgtcccccgccgatgtcgtcagtgttgccgtccgggaggagggcaaggcctgccgtgtggtggtgcccgacgaccagctctccctggccatcggcaaggagggccagaacgcccggctggcggccaagctgacgggctggaagatcgatatcaagcccgcgtccgcccccgccgatgaggagccggaggacgaagaggacgtcctgctggacgacgaggccgagaccgaggaataagccctgcgggggcggcctcctgagtggggctggccctccctgggacccgccgcaggcgggacggcgcctgcgccgcacaagcgttttgccgagggcaaaaccttggtttggggcaattcagttgccccaaacgggatggaaacagggtccccgcaaaaaggccctgccttttgcggggcgggccagaacgcccggctggcggccaagctgacgggctggaagatcgacatcaagcccgcgtccgcccccgctgacgaggagccggaggacgaagcggacgtcctgctggacgacgaggccgagaccgaggaataagccctgcgggggcggcctcctgagtggagctggccctccctgggacccgccgcaggcgggacggcgcttgcgccgcacaagcgttttgccgaaggcaaaaccttagcttggggcaattcagttgccccaaacgggatggaaacagggttcccgcaaaaaggctccgccttttgcgggatgtccgcacacgtaggggccgatgcccacatcggcctgcgaggaggcgagaaaaatgcccaagaaaatacccctgcgccagtgcgtgggctgccgggagatgaagcccaagaaggagctcattcgggtggtcaagagcccggagggagaggtctccctggatttcaaggggaagaagccgggccgcggggcctatgtctgccccgatgcggagtgtctcaggcgggcgcggaagtccagggcgctggagcgggcgttctccgccgccatgcccgacggggtctacgacgcgctggaggcgcagatgagggagggcggcgatggataacgtgctgcatctgctgggcattgcccgcaaggcgggccgcgtggaggtgggggaggagccggttggtgcttccgcccgggcgcggcaggccaggctgattctggtggcctccgatgcggcggacaacagcgcccgccgggccgcccactttgcccaggcgggtaaggcgccctggttccgggtgccctacaccaagggggagctgggcggcacagtgggccgcgcatcctgcgccatgctggccctcaccgatgtggggctggcggccgccctgctggccaggctggccgccggagcgccggagacctacggcgcggcgtcggcggagctgagtgagaaggcggacaaggccctccagcgccagaaggaacagcgccgccacgagaaaaagctgcaaaagggcggaaggaagccgtgggcggccccgcccgcccggaaggagtccccgccggagcccgccgggaagcggacgctgccccggggcaggctgaccgtcaagaagaagacgccatgagaccatggcacacaataggattggaacaacgagggcttgttccaataagaaagcgcagcggccccgccgcgttttcctattggcgcaagcccgccgatggaggtggcttatttgctgaacaacaagtatcgcgtgcacgaggtggccaaggatttcaagaagaactccaaggagatcaccgacattctgacgaaatatgcgacggctcccaagaaccatatgcaggtgctggaggaccgggagctctccctgatcttcgagtacctgacccagcacaaccaggtggacaacatcgagagcatctacgccgaggtctaccgggagcccaaggctgccccggcccccaagggggagcccgccaaggccgcgccccaggcgcagaagcccgccgcgccggcgggcaggcccgcgccccagcagccccagggcaagccgcagccggcccagcagccggcaaaccggcccgctacccgcgtccccgagaagaaggtagtggacacccggaagggcggccaggtgaacctggagaagtacgacgagcggctggagaacctggctgcgggcaagaccaagcagatgcaggccggcaagcagaagttccagggccgcaaccagcgcaagggcggcttccagggcagcaagcgccgccaggaggagcaggagaagatgcgccggctccagttggagatcgccaaaaagactccgctgactgtcaagatcccagacgccatcggcgtgggcgagctggcctcccgtatgaagaagaccggcgccgaggtggtcaagaccctgatgaagaacggcgtcatggcctccctcagcgacgtcatcgacttcgacaccgccgccatcattgccgaggagctgggctgcaaggtggaaaaggaggtcattgtcaccatcgaggagcggctcatcgacaccgccgaggacaaggaggaggatctggagccccgcgcccccgtggtggtggtcatgggccacgtcgaccacggcaagacctccctgctggactatatccgcaacgcccacgtggcggcgggcgaggccggcggcatcacccagcacatcggcgcctatcaggtgaacgtgcagggcaagaccatcaccttcctggacacccccggccacgaggccttcaccgccatgcgcgcccgcggcgccatgatcaccgatgtggccatcctggtggtggccgccgacgacggcatcatgccccagacggttgagtccatcaaccacgccaaggcggccaacatccccatcatcgtggccattaacaagatggataagccggaggccaaccccgagcgcatcaaggagcagctcaccaagtatgagctggtgcccgaggagtggggcggcgagaccatcatctgccccatctccgccaagaccggcgagggcatcgacaatctgctggagatggtcaacctgaccgccgagatgcaggagctcaaggccaaccccaaccgctccgcccacggcgcggtcatcgaggcccggctggacaagggccgcggccccgtggccaccctgctggtgcagaacggcaccctgaagcagggcgacgtgatcatcgccggcaccgccgtgggccgcgtccgcgccatgaccagcgccaagggcgagaagctcaccgaggcgggcccctccgtgcccgtggagatcatcggcatgggcgaggtgcccggcgcgggcgacgacttccacgccgtggccgacgagcgcatggcccgcgagctggtggagcagcgcaagcatgagcagaagatggccgcctccgcccccgtgggcaaggtgagcctggaggacctgttcagccagatcaagcagggcgagatgaaggatctgaacatcatcgtcaaggccgacgtccagggctccgccgaggccgtcaaggccagcctggagaagctgtccaacgaggaagtccgggtgagggtcatccactgcgccgtgggcgccatcagcgagagcgacgtcatgctggccaccacctccaacgccatcatcgtgggcttcaacgtccgccccgacaacaacgccaaggagtccgccgcccgcaacaacgtggatatgcgcatgtaccgcgtcatctacgactgcatcaatgagattgagaccgccatgaagggcatgctggctcccaagttcaaggaagtggagctgggccaggccgaggtgcgcaacgtgttccgcatcaccggtgtgggcatggtggccggctgctatgtcacaaacggcaagatgcagcgcggtgcccagatgcgcctgctgcgggacaacatcgtcatctacgacggcgccatcgcctccctccagcgcttcaaggacagcgtgaaggaggtcgcccagggctacgagtgcggcatcaccttcgagaagttccaggacatcaaggagggcgacgtgatcgaggcctatctgatggagcagatcgaggtgtaaccctgcctcctgcggagtcccctcctcgcggcaaagccgctgcggcctacgctaaaaatttgccgcaggcaaattttcttcacgctgcggtggagcagatcggggtgtaaagctgttcccgcagcctgaaccgggccggagcccagcgaagcgggtttggcccggagaggagacgtagcggaaggagcgagctttgccgtaagcggcaaagcgagggatctgaagcttgcggcgacgaggtggagcagatcgaggtataaatttctttcggcttcgtaaaacgccgtaggggcgacccttgtggtcgcccgcgggcggccataaaggccgcccctacgatatggagtggccagatggggcgtgcggtatgctgccgggctatcgtgccgcatgtctggcctcacccgaggaattcgcaggggccgatgcccacatcggcccgccgcgccccaagccggtaaaaaaccaaatcagacccgttccgtccccaagtcatttgaggagggggcgggtctgtgcgtctttatcgggaggatttttatgagcgccgtcaccctgctgtgtgccgaccgccccctgcccctgtacgagtccggtgtccgccgggtcgagaccagctcctatggtgggtacacggtccgtattgaggcgagcggattttccgtgggggagcacacatactaccgggaagcggtggaggatctgtacctgaccatgaagccctgccggtaccagctggatctgcgggccacccaggaggacgcggcggagctgagggcctatctggcaaagcatctgcgccccggagagaccgtggaactgtggaacctgtgggtggggaacgaccccgcgcgaccgaggcgcttttccggcgccctgggggatgtggagctggacaccctgaagcaactggaggagaacttccagacctgcctgaccattcgtatttgaccgggggcgcagccctctggaaaggagtatattatgccgagcaatcgcatcggacgcatcaacgaggagatccagcgggagctggccgccctcatccgcaccgtgaaggacccccgggtgcacggcctggtgtccgtcacggcggtggacaccaccccggatctccgctacgcgaaaatctacgtcagcgtgctggacaagagcgacgtgaaggaggtcgtcaagggcctgaagtccgccgggggctacctgcggcgggagctgggccgggcccttccgctgcgctacaccccggagctgcaatttgtggaggacgactccattgacaccggagcccacatcctgagcatgctccgcaacccggaggtggtcaagcccgccaacccggccaacgcccacatcgagctggacggcgaggagtgagcgccatgacggtgaaggagaccgccgcctttctgcggcagcatgacaactatctgattttgacccacaagcgccccgacggggacaccatcggctgcgccgccgccctgtgcgaggggctgcgggccctgggcaggacggcgtggatctgtccccacacggaggagacccacctgttcaccccctatctggagggccgcctggccccggagggctatgttccggagacggtggtgagcgtggacatcgccgcccgcagcctgttcacccgggctggagaaccctggctggcgcggggggttgatctggccatcgaccaccacccctcccaggcgttttttgcggcgcagacctgcctggacgccgggcgggccgcctgcggcgagctgatctacgacattctccgggaactcggccccatcacccccgccatggcgatacccctgtatgtggccgtgtccaccgacaccggctgctttcagtacagcaataccacagcggacacccaccgggtggccgccgccctgatggacaccggcatcgacgtgttccccctcaacaagcgccacttccgcaccaagagctgggcgcggctccaggtggagcggctgctcaccgagcggatgcaccgctatgagggcgggaaaatcgctgtggcccccgtgtccctgtccctcatggacgaggcgggcgcaactgaggaggatatggaggatatcgccgccttcctgggacagattgagggggtggagacctccgtcaccatccgggagctggcggaggggggctgcaagctgtccgtccgcaccagcggcggcctgaacgccacgaaggtgtgcgccttgctggggggcggcggccacgcggccgccgcgggctgcaccgtctccggcaccctggtcgaggcggaggcggccatcctggacgccatccggcaggtggaggcgagggcatagaggccgcggcctacgaaccagaaaagacgccgaaatttggcgcacaggaggccacttttatggcaaatggaatcatcgtgattgataagacccaggagtggaccagcatggacgtgtgcatcccacagatgcaggcatctgcgggaaccctgttttaaatcatcctcggcggaagcacccgcaaggggtacgccgcatccgtacagcagcggagctgctgacggctgcgcagtaaattccgcctgcggcgaggttttcgcgattgcgaaaacgctcggacggcacaaaagtgccgaaatttggcgcacgggaggccacttttatggcaaatggaatcatcgtaattgataagccccaggagtggaccagtatggacgtgtgcgccaaaatcaggggcgtcctccatgagaggcgggtgggacacgccgggacgctggaccccatggccaccggcgtgctgcctgtctttgtggggcgggcgacgcgggcggtggagtttgcatccgaatccgaaaaggaatacatcgctgggttaaaactcggcgtagttaccaatacccaggataccaccggccaggtggtggaggagcgccccgtggaggcggatcgggcggacctggagggggcgctggccgccttccggggggagatcacccagattccgcccatgtactccgccctcaagcgggacggtaagaagctctatgagctggcccgggcggggaaggaagtggagcgggccccccggcccgtcaccatccacgccctggaggtggtggagcagaccgggccgaactgctataccctgcgggtgcgctgctccaaggggacctatgtgcgtaccctctgccacgacatcggggccgccctgggctgcggcgggtgcatgtccgccctgcgccgcaccgaggccgccgggttttccctggcggaagcggtgccgctggaggcgttgctggacgcacctgacccggcggccctgctccggccggtggacgcctatttcttccgttatccggcggtgacggtggaagggacggccctgcgcaaggcgaagaacggcaacccgtttccctgctccgcggccgacggcgactggcgggtgtacggccccggcggggaattcctgttgctgggccggtgcgccggggggatgatgagcactatcaagagctttttcgaggtgtagcggtatgcagacagagaaacgtgtgatcgccttgggcttttttgacggcgtccatctgggccatggggccctgctgcgccgggtgggggagaaggccgcagagctgggggccgttcctgcggcggtcacctttgacacccacccggagaacctgattttaaaaacccctgcggtccccctgctcagctctcccctggaccgggcggagctaatgcggcggttctacggtatccgagaggtcattgtggcccactttgacgagcggatgatgcacatgccctggcgggaattcgtcaccgattatctggcgggggagcatggggcggtgcacctggtggcaggccatgatttccacttcggctacaagggggagggcaacccggagcggctccaggccctctgcggggagctgggcatcggctgcgacattatccccaaggtggtacaggaccatatcaccatctcctccacctatatccgtaccctggtggcccagggggagatggagcgggccaaccagttcctgggccacccccacaccctgaccgacacggtggcccacggcaagaagctgggggggactttggggttccccacggtgaacctgcgttttcagccgggggtgctggtgcccgctcacggggtgtacgcaacgcgggtgacctttgaaaacggcgagagccgcccggcggtgaccaatatcggagtgcggcccacggtagacgacggagaccgggtgactgtagaggggttcatcctggattttcagggagatctctacggccagacggtccgaatggagttctacaagcgtctgcggggggagcggaagttccccagcctggaggcattaaaggacgaggtcatgcgcaacgcggagcagacccgggcctatttttccacgtagccctgagcccctgagactgaggatgaggaaagagagggagccccatgcgttataaaaagctctaccccgccgtcatctgcttttgcgtcttcctggctgccatcggactggtgctgggcgatccgtccactgtgctgccaggactgtggaagatcatcgttacggaggacgcgctgatcaccgactacgtgaaaattgcgggtgtaagcgcggccctggtcaactccgccctggtgacgctggtgagcctgctgctgctctacctgagcaaggagccgcccaacggcttcacactggtggagctgggcctgatggctggcttttccctgttcggcaagaacattgtcaacatctggcccatcatcgccggtaccttcctgtacgccaaggcgcggcgggagccgttcggcaagtatgtctccgtgtccctgctggccacagccctggccccggtggtgagttatgtggcgctggacaacggcttcggcaacctgtggtggggtatcgccgtgggactgctcatcggctttgtgctgccgcccctctccgcctatacatacaaaatccagaacggcatgaacctctacaacatgggtttcgcctgcggcctgctggccatgatcctggtacccgttatgagctccatgggggccaatcccaccgtggcccaccactgggcggagggctataacctgcactttgctatcttccttggggtgctctgcctagggctgactgtggcaggcttttttttcagcggccgcccggcgtgggccgcctgggcggggtaccgccgcctgctgcgcaccaccggccgggctcccagcgattaccttcgcatgtttgggcctgccccggtgctcatcaacatgggggtcaacgggctcatcggcatggccttcatcctcgccaccggcggcgatctcaacggcccaaccctgggcggcattctcaccatcatgggcttctccgccttcggtaagcacgcccgcaacatcacccccatcatgctgggcgtggtcatcggcggcgtttttatgcacttcgatatcaaccagagttccgtgcagctcgccctcctgttcggaaccactctggcccctatctcgggctatttcggctggcccttcggcatcgtggcggggttcctccactcctccgtggtgctccacgccggaaccccggtggagggcattaacctgtataacaacggcttctccggcggcctgctggccatcgttctctatcccatcatcagcgaggccatccgccaccactggccggggctccaggaccgcgactacttcgatgacaccatcgagcacgacgagcccctggtcccgcctcctgcccggcgaaaatgaaaatgaggtcaaaagaggtgcagcgctcccgaaggagcgctgcacctcttttttgcgcagagaaggcagggatctatccaaaacgctgccgaagaacggacatcaatttgaaaaagtgtaccttttcaaacaccctgcctttgttctataaattgaagtatagcatagaaaaggagcaatatcaatcactttatggaaaggtaatccttacaatctgctgctttgaaaaggtacacaattccaaatcagaagatgggaggcagatttatttatgagaagcaggttactaaagatattgatatgcttaattatgattatttcttatattccgataactgcaatttctgttgagtcaggagaatcagtggtagatggaagcacggcaggggcgccaatcgcagtgccggaagaagggcttgctatttcgggcggaaccttatatggaatcgataaaacatggtttgcaaacgttaatcctgataagggaaagatctatttggctatctctatcccctcaggcgtgacggaaattaataacgatgggctcaaggattcttatacaagcgataaaaaattacatgatgcagtcacatatatggatgggttggggagtttcagtgttgcagctcttagttttgatgatgcaactggacttgaaacaattggtgagcaggctttgcaggggaacagccaactgacagggatacttgatttatcagcgacaaatgtctcagtaattaaaaaaagcgccttttccggctgctccaatctgacaggagttgttctaccaaaaacgttgaaagaattaggaagcagatcatcctctgccggttctgtatttaacgggtgcgaaggacttcggtatatccgcgtggccggtagtagtaaccagaatgcggtttttgaactgccggagggccttacctatattggaaggcagacatttaagaactgttttgcttccgatgtggatgcaaaggtaattattcctgctagtgtagagacaatcggaagtgaggcgttttacagcaaacggatttcccagatcatcattcaaaaggaaggagacggatgggatccacgattaaccggatatgatacatctgcatttaaaaccggaaacgatgacctgttggtggtgtttttaaataggaaaagctatgtggactatacagtgggccggagctttacaggggcggtaaaacgtgcattgtcctatccggtgacgctcacctttcagaatgccaaagagggtgtcatcaagcaggataaactaaactatcagtccattcagtatgagtatgatgaggcagcaggattttgggccgtcaaccaggactatctgcttccgcagcccgcaggagaacaggtgtccaagcccggttataatacattttggacagtggacgacaaaaaattgacagacagcggaaaaataaatattacttcagataatccaacggtagaaatagactatgtcatacagaacccgacaattcaacctgttgcggacggtactgttcaagcggatttccacacattaagcatagatttggatgcggcgggcccgcataccgtaggggtacaggtttcacacccactgctgaaagagcagcagggcacagaggatacctatgtgtatttccaatactgctggtgggatgaatccggagaggaaagcggtgtcaacggccccagaagcagggcggaacctgaattgttttccagctccgctgaaaacggaattctaaatcgtgtcaagacggaaaatgcggtcattcctatcgacggccaggagcacgccaggaccgatggacactactacatggtcgaaatctatggttacctggtggaaaacggaggtaccccggagcttttctacaagtcccatcacaattttattgatttcggttcggactccgacacggaggcaaccgtgagcaggagctatacactccaagtggaggtaactcaggtagagcgccatgcagttctcttccagactggtgagcatggtacgctggaggggacttccaactttgcagtaaaagacgggtccacgatgcgtaagagcggttatcctgtaccgagcgttgctgcggacagcggatacagctttaccggctggctgggaacggatggtataacccgcaccagtaatgaagtgctggatctgacggtcaccggggacatgacctttacggcgcagtatgcaaaggattccggctccggcggcagcaccggcacgacccggtacaccattgaggccagcgcgggccatggcggcgggatcagcccggacggcagggtgcgggtgagccgcggcagcgacaagaccttccgcatcacccccgatgccgggtatgagattgccgacgtgctggtggacggcgaaagtgtgggcgcggtcagccgttacacctttgaaaccgtgcgtaagaaccacaccattgaggcggagttccgcgccgtggagaaggccccggatacgggcgtggaccgctggctcaacaccaccgaccatatggcctacctcaatggctacggaaccggcctcttcggccccgacgaccacatgacccgcgccgaggccgcgcagatgttctataatctcctgctggatcaggacgtctccagtacggtccgcttcaccgacgtgcccgccgacgcctggtacgcccgcgcggtggagaccctggcctccctgggcatggtggaaggcgtaggcggcgggaaattcgccccggagcgcaccatcacccgggcggaggtgacggccatcaccaaccgcctgctggaccgggcggcggacgaggactacgtggacgaccacgccggcgagctgcgccagttccccgatgtgagcgcctcctactgggcctaccacgacattgtggaggccaccaacgcccacagctaccgtgtctatgacggcgaggagcactggatgtaagcgggaaatggcaaggcccccggaaccaatcggttccgggggccttattcagccggcctggattgcctcataggcctgcatgccccactcgcccagggcgcgcagataggggtcaatggaccgccccagcgccgtcagagagtactctacccggggcggaatttcgggatactgctcccggtggaccagcctggctcgctccaactcctccagggacttggagagcatgacgctggagatgccctccagccgccgttggagttcgttaaagcggattacctcctgctggttgagctcccacaggatgcgcagcttccacttgccgcttaccagccccagggcaaatttgaccggacagccctccatggtgttgcctccccactaagtattttcttaccggctaaagaaaaattgcgtacttgtacttttttcgccgctgtctataatgataccaacaaggaccagaaaaggaaaggggtattttaaaatggaaatacagcaggcgattgagatccggcggagcatccgtgcctacggggaccggccggtggagcgggagaagctggaggccgtgctccgggcgggcaaccaggcacccatcttcggccggctccacatgagcgtctttgcggggccggagcagctccaagcggtggacgcggcggcggtggcgggcatggcccgctccggcgtgcccttcctggagaacctggccgcccaggagggctatcaccctctctacggcgcggcggccctggtggtgctctccgcccccggcggcctggatgagaagggcttcaacatggccaatgtatcctgcgcggcggagaacatgctgctggccgccgctgggctgggactgggctcctgctttctgatggggcccatggccgccttctccgacccggcgctgcgggcccggctggagctgcccgagggctacgagcccctggtaggggtggccctgggctacgccgctccggagcaccccgccgccccggagcggacggatgccggtatcacctggtgcagataagcaaagcggaggccgcccgagtgatatgtaccccctttactggacacccagtagagggggtattattatgcggtacacatatgagtacaaaaggaaatgtgtagaactgtatcgagaaggaaaatggccagaaacgccggaaggtgttagcgataaatcctttcgggataaagtgagactatgggtaagagcagaggatagccgcggtccagaagcactgaaacacaaaaatttcaacaggaactggacaccagaagaacggctggaactagtatcccaagtaatgtccggaaaatcctgtgtgtcagtggcaatcgaggccggtattcaagatagactattgtatcaatgggttcaaaactataaaacaaaggggtataatggcctggtagaaatgaaaaaaggtcgtccaagtaaaggggtaccccaaatgaaaaaggaagaagcaaggccactgaatgaatccgaacgagaagaattgatccggcttcgggcagaaaacgagtatataaaggcggagaatgaagttataaaaaaagagatcgccttgagagaagagaggcacgcagcgcaactcaaggcgagaaagcagcgatcatcaaagagctgcgtgaaaaaggataccaattgaaatatctgttgaaatctatgcagatggcacggtctacctattattttgagttgagcaaggccgatcaagttgctgttcgaaaccattgcttggcagatgaaatcaaagacattttctcacagcataaaggccgctacggtgtgcgaagagtatatcaggaactgataaagcgcggccacaaggtcaatcataagcgggtacaacggcttatgcacactatggggttggcaggaaagcgcccaaaggaaaagtatcattcctacaagggcgaggtcggcaaggttgctgagaatatccttgaccgggatttcagcacgacagctcctatgcaaaaatggactaccgatgtatctcagttcggtttttcgtgggggaagtgttatctctctcctatactcgacatgaacacaaacgaaatcatttcttatgatttatctcaaagtgccaatatggaacagatccagagaatgttggccggcgcctttacgaagtttccctctgtagatggcctgatctttcactctgatcaagggtggcagtaccagcacgtgtacttcaggcaggcacttaaagatcacaaaatcattcaatccatgtcaaggaagggcaactgttacgacaattgcatcatggagaccttctttggacggatgaaaaacgagatgttctacgggcatgaaaaagagtattcctcttttgaaacatttgccaaggctgttgacggctacataaattactacaacaacgaaagaatccaagagaaaacaaaatggatgcctcctacaaaattcagagaggcatccatgtgcacctaattcaattttttatgtgtccagaattctgggtacatatcagagagggcggcctccgctttattcgctgctttatttgctttcagcggagggcttgggcttgttgggctccaccgagtcaaacacggccttggcggaggcgcacaggcccgccaggccctggatctcggaggggatgatgatcttggtggccttgccgtcggcggcggcctggaaagcctccagggccttgatgcgcagcaccgcctccttgggatcggcctcgttgagcagcttgatggcctcggcggtggcctgctggaccttgaggatggcctcggcctcgccctcggccttcttgatggcggcctgcttggcggcgtcggcccggagaatcatggactccttctcgccctcggccaccaggatctgactctggcgctggccctcggcccggagcaccgcctcgcgcttctcccgctcggccttcatctgcttctccatggcgctctgtatgtccggagggggctgaatgttcttgacctctacccggttgaccttgatgccccaggggtcggtggcctcgtccagcagggcgcgcatctgggagttgatggtgtcgcggctggtgagggtctgctccagatccatgtcgccgatgatgttgcgcatggtggtgacgctcaggttctcaatggcggacatgggccgctccaccccgtaggcgtagagcttagggtcggtgatctggaagtagagaaccgtgtcgatctgcatggtgacgttgtccttggtgatgacgggctggggcgggaagtccaccacctgctccttgagggaaaccacctttgccacccgctccaggaacggaaccttgaagtggatgcccacgccccagacggagtggaaggcgcccagccgctcgatgacgtaggccttggactgctgcaccaccttcaggtttgtggccagcaccagaatgagcacgacgaccaggataatgatgataatggggataaacggcatgcgggattcctcctttttctcttcctcggtttggaattaccgccccggcgtagggacgggcaggggggacacgatgaccttgacgccctcgatgcggagtaccctgacccgggagccggcggggatggcggggcagccctcctcggtgcgggcggtccagggggcgccgttcacggtgatctggccctgggccttcaggttgtcgatggcctgggtgaccacaccttcggcaccaatgacccggtcggcgttggtgctcacccggcgggggtcggcgtactttttggccagggggcggatgatgaccaggcacaggaaggacaccgccaggaatacggcgaactgcacccagatgttgcccacaaagaaggacgtgagcagggcgcacagggagcctaccgcaaaccacagggaaaccagccccaccgtggcggcctccaacgccagaagggcgacgagggcggcgagccagcagatgcttggtatgggcatgggcactcctcctttcgaaatactactgctatcctagcacaactcggagaaaaagggaagcaaattcgctttccagatttgccaagcagagaaaaataaggtatactgctgtctaagaacgagaacggagcgaggcgatggacatgagagagctggaattgctggtccccaccctgttcgggctggaggggctgtgcgctgaggagctgcggcggctgaagctgccggaggtggcggcggagaacgggcgggtgcggtgcaaggccgccccggcggatatcccacgggtgaacctgaacctgcgcaccggcgagcgggtgctgctggtggtgggccgctaccgggccgccgactttgaggcgctgtttgagggctgccgcgccctgccctgggaggaatttatcccccgggagggggccttcccggtgaaggggcactccctcaactcccagctccacgcggtgcccgcctgccaggccgtgctgaaaaaggcggccgctgcccggctgggggagaagtacgggctggaaaccctgccggagagcggggcgctgtatcagatccagttctccatcatgcgggacgaggtcaccctgatgctggacaccaccggggtcgggctccacaagcggggctaccgggcggtgggggtggccgcccccctgcgggagacgctggccgccgccatggtgctcctctcccgctaccgggggagggaccccttctgcgaccccttctgcggctcgggcaccatcgccatcgaggcggccctcatcgccaaaaaccgggcgccgggcctcaaccgggccttttccgcccagaagtggcgttggctggacagcgggctgtggctccaggccgccgacgaggccatggacggcgagtacgacggggcatacgacatctggggcggggacatcgaccccaaggcggtggccatcgcccgggccaacgcggagaaggcggatgtggaggacgcggtgcgcttcgaggtggcggacgccgccgccttccgccgggacgcgccctatggccgggtggtcaccaacccgccctatggggagcgcatcctggagaagcgggaggcggaggagctttaccgggctttcggccgggcggtgtgcacgctgccggaggggtggcgggtgagcgtgctctcctcccacacggagttcgagcgcacctttggccgtaccgcagacaagaagcgtaagctgtataacggcatgctcaagtgcgacctgttccagtacggaagataggaggaggggattgatatgaggcgaggaaagggaaagcgcgccctggcggggctgctggccgcggccctgtgcgcgggattgtttttcctcccggcctccgccgcgccggagggggccacggtatggggctacagcgaggggctggcccagtgcgagctggccggaaagtggggctatgtggacgctggccggaatgtggtcatccctctccagtacgacagcatcgtgtccttccagctcggcatcgcggcggtcaacctcaacggcaagctcggggtgatccggcaggatgggcggtatctcatccagccggagtacgacacccttctccccattgactgcgggctctatatcgcccaaaaggggggcggctggggcgtggtcagtatactccccttcccggacggggcggggagcaccaccaatgtgctctatgagctgagctatgaccaggtccaggtggccgagcagggcggaactcaggtgctcaccctcaccaacgggagcaccgtcaccaaaatcccggtctatgacctgcccggcatcctggcggccaagggggtgccctccgcccagttccccctcacccggggcaagctgccctccttctccgatgtgtccccccaggactggttcgccctctgggtggacatcgcctacaatgtggggctcacctccggcgtggggaagaaccgttatgcgcccaatcagaccttgaccgtggcggaggccctcaagctggcggccacgattgagagccgctaccagggggacgactttcatctgagcaccgaaggcggaccgtactggtatgtgccggcggtagattactgcctggccagcggcatgattcaaaagggggactttaccgagcgggattacggacgggctgtcacccggcgggaggcggcggagctctttgccgccaccagtctggccaaggccatgccggaactcaactctctggcccgggtgaaggcgtcggtgcccgacatccgcagcggcgatgagggggcggaggccatctacagcctctacgccaagggaatcctgtccggggtggacagccggctgaccttccagccggagggcaccttcacccgggcggaggcggcagccattgtctcccgcatggcccgcaccgagcagcgcctgctcctgtggagctgaccaacggataaggaggatgggccctgtgaggcacctgttcttaatcaacccccacgcgggaaaatacgaccgcacccaggagatgcgggagaagctccgcactgccttggccgggcgggacgagccatgggaggcggcggtcacccaataccccggccacggggccgagctggcccgggcggcggcggagaggggggagccggtgcgcatctatgcctgcggcggcgacggcacccttaacgaggctgttgccggagccgcaggcttcggcaacgccgctgtgacccactaccccatgggttcgggcaacgattttctgcggatgttcggcccggatgcctgccgcttttacgacctccgggctctgctggacgcgccccaggcgccggtggatctcattgagtgcaacgggcggctggccctcaatgtctgctcggtggggttcgacgcccgcatcggcctcggtgcggcagactttaagaagctgcccctggtgagcgggccgctggcctaccagctctccgccgtgcgcaccattgtccaggggattcaccggccttaccgggtgaccatcgacggggagcgtctgccgggggaggcgtttaccctcatttgcgcctgcaacggccgctactatggcgggggctttaacccctgccccgacgccgtgcccgacgacggcctgctggactttgtagtggtgccggctgtctccaggctgaccattctgacgctgatcggcaagtacgccaaggggggcgccggggatatcccgcggatccttctgcgccgcggccgggagatgcacgtcgcctgtgagcgggccgaccggatcaatttggacggtgaagagctggtggattctgagctctctgtccgtgtgtctgctaaaaaagtaaactttttctttcccgaaggaacccattggattccggagaaacgggtgcgaaattagaaaacagaagagagcgggagaaaaaagaagatctgaacaggttttgaatgttaaattgaaataggaaccgcgcggaatggaaatttaacagattatttaaaaattaagacttgcggaatccatcaagtgaggttattattataagcaggttagcactccggtaaaatgagtgctaacctgctgaattggtttacaagaaaaatgaatgatacatgaaggaggaaccccttatgaaactcaagccccttgcagaccgtgtggttatcaagctggtcgaagcggaggagaagaccaagagcggcatcatcctgaccggcgccgccaaagagaagcccgaggtggccgaggtcatcgaggtcggccccggcggcgtggtggacggcaaggagatcaccatgaccgtcaagaagggcgacaaggtcatcaccagcaagtactccggcaccgaggtcaaggtggacggcgaggagtacactatcgtccgtcagggcgacattctggcgatcgtagaataacccagcggaacggcgagataagccgtccacctggggccccgcctggggcggggcggcgcgataagcgccggaggccgacggaattcatttccggcggccgcagatgaaatccccgggggtccccgcgaaattctgtttcgcggggcggacggcgaggagtacactatcgtccgtcagggcgacattctggcgatcgtagaataacccagtggaacggcgagataagccgtccacctggggccccgcctggggcggggcggcgcgataagcgccggaggccgacggaattcatttccggcggccgcagatgaaatccccgggggtccccgcgaaattctgtttcgcggggcggacggcgaggagtacactatcgtccgtcagggcgacatcctcgccattgtggagtaattttccgtgtaggggcgcacagtgtgcgcccgctctctggaacaagaaatcttccgggtgagttccacccgactcaatttggaggtaatacgttatggctaaaattatctgctacggcgaggaagcccgtcacgcgctggagcgcggcgtcaaccagctcgccgataccgtgaagatcaccatgggtcccaagggccgcaatgtagtgctggacaagaagttcggcgcccccctgatcaccaacgacggcgtgaccatcgccaaggagattgagctggacgacccgtttgagaacatgggcgctcagctggtgaaggaggtctccaccaagaccaacgatgtggccggtgacggcaccaccaccgcaaccctgctggcccaggccatcatccgcgagggtctgaagaatctggccgccggcgccaaccccatggtcatgaaaaagggcatcgccaaggccaccaccgccgcggtggaggccattaaggccaactccaagaaggtcaacggctccgccgacatcgcccgcgtgggcaccgtgtcctccagcgacgagaccgtgggcaagctgatcgccgaggccatggagaaggtttcccacgacggcgtcatcaccgtggaggagtccaagaccgccgagacctattccgaggtggttgagggcatgcagtttgaccggggctatatcaccccctatatggtcaccgacactgagaagatggaggccgttctggacgacgccctgattctcattaccgacaagaagatctccaacattcaggagctgctgcccatcctggagcaggtggtgcagtccggcaagaagctgctggtcatcgccgaggacgtggagggcgaggccctgtccaccctgattgtcaacaagctgcgcggcaccctgaatgtggtgtgcgtcaaggcccccggcttcggcgaccgccgcaaggagatgctggaggatatcgccgtgctgaccggcggcaccgtcatcacctccgacatgggctatgagctcaaggaggccaccatggacatgctgggccgcgcccgccaggtgaaggtctccaaggagaacaccatcatcgtggacggcgccggctccgccgacgccatcaaggcccgcgtcaaccagatcaagagccagatcgagactaccacctccgactacgaccgcgagaagctccaggagcgcctggccaagatggccggcggcgtggcgatcatccgtgtgggcgccgccaccgaggtagagatgaaggagaagaagctccgcatcgaggacgccctgaacgctacccgcgccgctgtggaagagggcatcgtggccggcggcggcaccgcctatgtcaacgccatcgcctccgtggagaagctgctggccgagaccgagggcgacgagaagaccggtgtgtccatcattgccaaggccctgaccgagcccatgcgccagattgccaccaacgccggcatcgacggctccgtggtgctggagaatgtgaagaaggccgacaaggtgggctacggcttcgatgcctataatgagacctatgtggacatgatctccgctggtatcgtcgatcccaccaaggtgacccgctccgctctggagaatgcggcctccatcgccgccaccctgctgaccaccgagtccctggtggccgacaagccccagccccccgctccggctgctccggctgcccccgatatgggcggcatgtactgagccagagagaaaaaaggcccggaaccgatttggttccgggcctttttgcagggctgtggcctgtcgacggggctaaaaagagctgctgcttccggcatacggaaaagcaagaaatacgaaggcacccccggagccgttggactccgggggtgcctggtgtgtagggggagatcaatcaggccgcggcctgggcggcagcggggatcaactgcgcctggaagaaagcggcggtggcgtccaccgtctgatagagggcagtgaaatcgccagagaacacgttgtaggtgtggtcgcagttatccaccagcagcaactggctgtcggcgttagcggcggccttcacaatcttctcggcgttatcgggggtgacggtagtatcgtccttgccgttgatggccagaatgggggccttgatgtcagcagttaccttcagaatgttggtttcggccacctcctggaaccagcgctcacccagctccaagggctcccgccagtcaaaggtcatcgtataaaagccctcttttttggcctgggcataggcatcctcaaagctggtacccgcaaacagggaggcgccgttcagctccagggcgccggaccaggtgacaacagcctggaaggtgtcggggtgggcctctgcggccagcagggcgtcggttccgccctggctccagcccatgacgcccaggttcccgccgtccacagtctccaggccggccaggtagtccgcggcggccttggcgtcaatgacggcggaggtgtagttgtaatcccggtagctggcggtggagtcgccgtttcccatgaagtcgatgcgcagggtggcgatgccgtcggcggccatacggggggcggccagggcgtaacccatgccggcttcgtcccggttggagccggtgccgtggagcatcaccacgccggggaccttcgcgtccttggaggcggagacgggcagggtcagggtggcgggaatctcatgggcagggatcccgtcctgggcggctacagggatggaaaccacggtctccacataggtgggcttgaggacgctgaagttcttgagcacctgggcaaactcagcgcgggtgagctggccgttggggttcagattgcccttctggtcaccggtcatcaccttgccataatagcagaaggtcatgccctccagatcggcggcggggatggagtcgtagtcgggagcctccttcatagccatgccggaggtgtccacggtaatacccttgtaggaggcgtaatcggcgataatagtggcgataccggaacgggtgattacggtgtcggtgccgtactcagtgccctcaaacaggccggcggaggcggcccagttaatggcgttggcgtaccactcgccctcggtgccggtcacagtggtcttttcaaccgcgggcttaccctccatgttatagagggtctggtacacggtggcgcgggtgacggtgccggtgggctcaaagcccttgttggtgccgttcatgatgccattgtccaaggcatacacggcggcgttgtagtaccaggagccggtctccagatcggcgggatagttggcgggctcgtccacaatggtgatgcggccggcgggctcgccgtactgctcggcggtgatggtgccgtccagctcctcagtggtgtagttgatcagggcgtcctccagggacacgcccacatccttccagccgccggcggtcttgaacacgccgtaggtgtcgccgcccttggcggtgaagtcgttggtggcgatggtgtaggtggcggcgggatcaaaggcctcgccgttcaccgtggagatggtgacgcggctgccgggattggcaggagcgtagtaggtagagttggcgtattgagtgccgttcacatagggaacgccggtgttgagggtgaactcaatgccggacacctgggggaaggcgccgatggcctcgggggtggtgcaggtagcggcctccagggcctccagaagctgggcgccggtcacgtcgatggtggccacggtgttgccgaaggggaagacggccagcaggctcttcttggaaatgtcgcccttggccagagcctcgcggatgccgccgccgttggtcagcgcggcgtccacgttctcctcgcccagagtctggcgggcctgccacaggatggcgtcggcggcaaagtcgcccaggttggtctcagtggtgcggacgccctcgccctcggggaaggtcatctcggccttggtaacaggatcggtggccgcaccgccggagcgggagccgttcagatccacctcggtggtggcgatcttctcgccgtagaccttatcaacggcggtgttgcggtcgtccaccagcttggccacatcggcgtcggtcttggtgtaggaggcggcgggaaccagctcgtcggtcagggtgccggtctcctgatcgtagatcaccacgcccacgttggccagagcggtgccagtggagacgatcttggcgccgttgaccacgttggtgtcgcccaccttggcaatgatatcggcagtggtggagtggctgtggccgtcgatgaacaggtcaatgccgttcacgtgctcacacacgtcgatggagcggttgccgatgctctcgtcatcgatgcccaggtggcccaggcagacaatcagatcggcgccggccttgttcagctcatcgacctgagcctgggcgacggcgtacagcttgtcggtctgggggaaggtgatgccgggcatcttggaggcgtcggccttggtcagggtctcgggggtggccaggccgaacacgcccaccttcacgccgccgatctcaaagatcttgttggagtcgaagacagtcttgccgtcggcctcagtggtcatgtcggcgcacaggatggggaagtcggcatccttggccagggccttgaggttgtcgatgccgaagtccagctcatggttgcccacggtcatggcatcataaccggcggcgttcatgaactcgatggcgctcttgccctggtcggcgctcaccaggggcttgcccatgatggagtcgccggcagagaccagcagcacatcggcgccagcggcctcgaagtccttcttcagctgggccacaccggccatgccgaaggaagtgccctcctcgtccagatccgcgccgtgggtgtcgttggtatggagaataacaaccttaccatcgacatcgggaatgacatagggggttgcggtttcttcctctgcggcaaaggcggccccgaacagggagcacaccatagccagcacgaggaacagggacaggaatttgcttgcgggttttctcatagaaaacattccacctttcctcattgcctttccctatgaaaggcgttttttggggcatcctaatggtaacaaactggaaacaaaaatacaaggtggcggagaaaaaaagtgtgcaaaaagcacacgaatcttatgagcccgctgctcaaaagattcgtgtaggaaataatttatttttcagcccagttgccggtggcctccgccttcagataggcgttgatgaagccgtccagctcgccgtccatcacggcgttgatgttgctggtctcatagccggtacggttgtcctttaccaactggtagggcataaacacgtaagaacggatctggctgccccactcgatcttgagctgtacacccttgatgtcggagatcttctccgcgtgggcctgcatctgaagctccaccagcttggagcgcagcatccgcatacaggtgtcccggttctgaaactggctgcgctcggtctgacaggaaaccacaatgccggtgggcttgtggatcaggcggacagcggaagaggtcttgttgatgtgctggccgccggcaccggaggagcggaacacctgcatctcgacatcctccgggcggatgtccacctctacatcgtcgggaatctccggcatgacctccagcgcggcgaaggaggtctgacgccgggcgttggcgtcaaagggggagacccggaccagccggtgcacgccgtgctcactcttgaggtggccgtaggcattctcaccctcgatggaaatggtggcgctcttgaggccggcctcgtcgccgtccaggtagtccagcgtcttgcacacgtagccgtggcgctccgcccagcgggtgtacatgcggaagagcatctgcgcccagtcctgggcctcggtgccgcccgcgccggcgtgaaaggtgaggatggcattggagccgtcatactcgccggtgagcagagtggacagcttggcctcctctatctcggcctccagcttggcgaagccctcctccacttcgggaaccagagtctcgtcctcggcctcgttgcccaactcgcacagggtcatcaggtcgtcccactgggtcttgcgcctttgctggccctcaatcttgtcccgtagctgcttgacccgctgctgcaccttttgggccttctccaggttgtcccaaaagccgtcggaagcgctctccgactccagcatctccacctcccggatggccgtctccaggcccaaggcctggtccagctcgtccagctctgggcgcagattgttgagctttaccttgtattcatcaaactgaagcatgtaaaaccacactcatttccataaaatagccctcatattatatccaaaagagtggaaattgtaaagagagtggcaggaaaaaaccgcccgagggcgggcggttttatcgctcactgaccatccagccgggatcggcgcggaaaatcaggtcatctatgtcttcctttggctcggtgcgcagaatggtttcgtcctgctgcgtgtgttgcatggggatacctccttcgtaagtcgtgtacatatcagtatatgccggagggagggaaagatgtatacgattcctgtcgggcggctttttaaaaataggggttgacaagaggctttgactgtggtattctaattgagcactcaaaagcaagagactggagccctccacgccggagtggcggaattggcagacgcccgggacttaaaatcccgtgggaggaatcccgtgccggttcgaccccggtctccggcaccatatcgcggggtagagcagcttggtagctcgtcgggctcataacccggaggtcggtggttcaaatccatcccccgcaaccataaagccacaccaatctggatattttgagcggaacgcttagagtatcagagggtgtggcttttttattttcctgaaatttgcgttctggaaaaaagatattttcgaggtttatggagccacagaaggacattgccctcccggattgctccataaaataccggttaaccctcccctgcgccctttttcagcctcaaaggccgccaaatggaggaaaaaatatatacaaaaagtagtgcgtcggtttgttggtttcgcaaccatcagaccggcgcttttttgttgcccgggaagttcaaaaagggcgcacacttttgtgtctgctttgctgaatagatttttgtagagatgatggtatggtgaaattcccgggcaggggtacagaacgataatcgaaaaagggcgctgagtccaaaggaggaatatgaatatgacccccaaaacctatttcgaagagctgtcctatgccctgcggcggaaggaattgctgccccgggcaacggaagaggatgggctgctgccggtagagtggaacggccgccccctgtgccggattacagaaagcggtgccgtccgatatgacccgacctgggtggtcaccgatcaggcgaaggttgccctggccgaggccgcaaaggcggcagggacagtgatggagtatatggccttgcttgagtcggcaccgctactgaaggcagagtacctggaggccggctatcgggtgctggcagatttcaacggcgttgtgctggccgggaaggagacgttgctgggggcccaatttgccacctgggcctggggctatgaccggaagggacttaacaatggccactactacagggaggactatcagggcgccaaggaggacttcgccctccgcgccgggctggtgaccagggaacgggtctttgaccaggagcagctggaggggctgcgacaggcggtgcagggcttcctctatggaaaggcccccgcctcctaccagcaggagttccaatgccggcgcctcctggatcagatcacagcccagctgccggaaagaacccaggatcagatgcagagcgaaagtcagaagcttggacagtccatgtgagggcggcgccaaatcaggcgtcgcttttttctatacagaaattgttggtattgcttggtttgcggcgtttttttcgttacgtatgatgatagctttatctcgccaaaacgggtattgttgtggtcagatacccaccccaaaaataacaaggaggacacacgtatgaaacagattgagaagcatcccgcaccggagaagctgcttcaacagataactgaggcggcaatcaatgccctggcgctgggcgggccggacaagattggggatgaggctcctatggaggcaggcgtgaagctgatcgccaaagcctggggcctgccccaggagagccagcaggccagcctggagctgattgaaagagaacggcagctcctgcgcagcgggagcagtgaggacgctttgcccaacagcgccctgctgaagccttacgatggcaagatgattacagagctgctctggggcctgtttgagacgacggtcaagctggaggatgcccaagaccgggtggcaatgcataagctggcccttctcatggcggaaagcctgaacctggacagttggatcgcagagtgcgggctatccaagccctaagacggaagcatacaggagggggctgtccttggacggccccttcgactttgcgcaaagaaggatcgtttgcttcggctgaagtggaaaggccgccctgtcccagagcgaagctaactaccggcggcagcgcaacatctaatagaaagtagggagcaaatcttgaatcgatcatgtgagggcggcgcccaaaagagcgacgccctttattgtgcccagattttattccatttcagtgctcataagatttacgccccggagcatccggcggaaccgccgcccaggccggtatgcacccattcccccctctgcgagggctgcccctaccccgccaacggcttcctctgctgggggaaggatgggacgtgcctgcgctcggagatgcggcggttcaatgccccaaacaggagggcagaacaagaaggcgaggaggagattcacacagatggatctatgtaacagccgcttccccctgtggccggccaccctcggggaggccagcctgttctattcaaatgaccaggcggacagggtactgggtacagtgggccatgtccggatagactttggctccagtggcaatgggttttatcacacctggtggccccacaatggggatcagttcaacacgccggagttcaaggaggccctgcagcagttcgtggacgccatgcgggcggatgggccgctgaagaacctgccctctatggacagattctgccggcagaacggcggggccatcacggaggacggtcggagttatgggtatctggcagagatgggcagctaccgtttctgcctccggtgcactcccagccccggggaataccagtgctatctgtactgctatgacctgcgccagcagacgctgaacaggccggtgggccgggtgacctttgccaacggcgagcacatggagttcacagctccgcagaattacctccggacaatccgtgaggaactgcccacaaaggatctgacaggctttcgctttgagaccctgacggatgaccctgcggtgcgcaaggcggtggacgatatggtctatgacttatatggggaggaaaaccccaggccgctggaggattacacgtcccgccaggggccatccctgagagagctatccatatgaaccgagggaaaaacatgcagaaaaaagaatttatccggcagctcaatgaactggttcccaggccggatcccgtcaccaccgaggcactgtaccgctttgaccgtgagtgcgcggagacggagtacatcgatacgctcacctccctgcgggtggtggcgcagaacttcagtgaggagacgctccagggcgcctatgagatcatccagtaccggaatgccgcactgcccagtgagctgttcgccgcagccgtctaccttcaggccgggcgtacaccggcggaagtgtccggcctggccaaggagggccggcttatgggcttctttggcccggagcggccggaagagctcagccggattgcgacctgtaccattgtggagtccgggcagaagcagcggttttatactatggacttcgggcggttcaatcctcagcacgctttgaagcaagctcaaaaatatggccaggaacgggaaatttcaacctctcaggccatggcctgcttcactatggatcaaccggagtttgctgcagaacccggcgggccccgttgtatcctgaatggcctggattcggagctcacagatgcgttgtttcagatctcgctgacctgtcctgccgtggctgcccatatcacctgcaatgcagatctgagtatcacagagatagcttatcatccactgtggctggagcggagccggagtctggcccctatgcagcagcagatgtaaaaaatgctggatcatccggacacatggtggtatgttgtgtgtttaccaaggaatcgggaggaaaatgatgatgaagcattcaaaaaagcagaacatgagcaaatatactactgggggctggcttccgttttggagaccagccttttctattcggatgatgctttcggtataacgaagggaggcagaccattatgcaggatctaccaaaggagtggctggagttccttcggggccaattccctgcaggcagccggatccaaacatgggagttggatgatcccaaaaacacgttggaggaggccgggacgctggagcacattgatgacgagggccggttccatgtccggcagagcgatggagaccaccgtattctgacgcttggtgaggataccttctccgtacatccgccggaatcccagctcaagctgtacatgccgctgaccgcagatttctatgcccgtaacgaatggggggacatggacgagtccggcgaggaatgggatggccgaagccttttggactacgaggacggcatcctaagcgccctggtgtggaaccgcatgccggaggaggcagagcgcgggctcatgcattggtatggcaaggaggacaacttagacgccaaggtgcgctccgctgtattcacggtggaggcgcgggacggtgtactgtggggcgtggccgagtgccaagttcttgacacgctctccccacaggaactgaatgggctaaaggactacatcgaaggccaggcatcggacggctggggcgaagagtttgagcagagggagatacaggtggagggcggggaactctacgtccacctgtggcaatcggagggctggagcatccagactgaggcggagcggttcgggcagacacagacccagaaatcgcacgatagcgggatccccaccgaaatgagtgagccttacccgcagggcgaggcgaaggatatgaagcacgggacgacgatgacgatgggaggtatgagccgtggataaggcatttacagtatccctgtgcaacccggacaaagaagtctatgtggccctggacttgccggcggagccctacgccctactggatgtgtgggagcggcttcggcccgccccgggtacccaagtggaatgggagatagaggactacggggaattccacattctgtttcccagccttcagtctggtgagaacttgcccgcgctcaatctcctggcggagcaactgtccgggctggatgagcggcagcgtaccgccttcgaggggctggtcaggctggatagcatccggagcagcgatattcctctgagcacgttcatcgcattggttgagcaggcaaagcactgtcatgtggtacccgaagctacggatgacacccggttgggacggttttatgcggcaaacgggtttatccccgaagtggagggaatgccagataaggcatttgagctgctggacttcaaacgactgggccgcaggatccgccaggccgagggcggtatctttacccgaggcgggtacgtggtaccggatggggcatggcagccgtcacagaacccggagcctcgcgctgccccggagcctccggctggtattttccggctgaaactccggcttggggaggaacaggccaaactcaccctccccgccggacgggaactggtggaggtgcgggaacggatggagtccatcggcctctccgcctgcgctgtcgcctcctttcacagccgggtaccccagatccctgcggagtgggtaaccccggagaggctggaagcattgaactgtcttgcccagagactggctgcgctggcagaacaggaatccctggccctgaccaaatataaggcggtgctggaggcttcgcctatttccagcctggaggaggccatagcattaacggagcgattggatgcctataacctggatcgtaaaccggccacgccggaggatgttgcgcgggaggagctgtcctgcgttatgatggaagaggatgtcactctgattgagagatacctgaacatctatggctatggcgaggcgttgatccagcagtatgaaggcgagcttacgaactacggtccgctgaccagggcggatggccggccggtgcaggaaccgttgccgtcccaccccgggctgaacagtattggaatgaggtgcccctgatatggacagagaaggactggcaaagcttcctggcagaccggaggagcaggcatggctgcaggagcggctggaggtgctgaccgtgcgggaggggatcgccctggacgcggccatccagcgccatcccgcccaggacagtacagaggcggtctgcctgctggccagcctggacgagtatgaggtgttgggcggcatccagagctatgaggatctgggcctgtattacttggaggagaccagcgccaggctcctggcgctgcgggactatatcgacctggacaagctgggcaggcgttatgaggaacagcaccccggactgtttgtcgggggttgctatgcggtatatccggagcgggaaccgccccagccatacgacggcgtcaccctgccggggccggactacagctggagcctgcggctgaaactggcctcccaggcggtgccggagggggtgtggctggctctgccggactacaacgacatcatggacgtgcggccgggggaaatccggctggccctggatgccctgggcgtgcaggctatccaggagtgtgccctgctggaagcccggtgcagcctgccaggcatcaccgggctggaggacgcctatgccggccggctggaagatctgatctacgacggccaaaacttgggcttcatcctccaggagcagaaccagggacagaaggggtttctccaaacctgtctctgggccctggagtatgagggctgcaccaccctgcccgccgccctgaatgtggcgcagaacctgaaccaatatcaggtggtgcggacagacataatccaagacttcgcccgaaaggaattgcgggcggtagcagacggggcagaagcggtagcagccggctgcttcgacctggaacgctatggacgggatttactgaagcagaggggctatacccagacattagacggcggggcctacatcctgggcccccatacccagacccaggcgcccacacagatgcagaagatgtaagctcataccatcatagatagatcgacaggggccgtttttccgaagaggacagcggcccctgcttttttgccccctttttcgggagagcggcccggaaaagggggacatcatgagagcaaaagaacgagagctgctgcggtacctgaaaaagcactgccttggccagcagaatgccctgggcggggagaagctgatgaaggtattccgcatcagcggaacagagctgcgcaagctgatccatgacctgcgggtagacggggcgcctatctgcagcgaccgtaccggctacttctacccctccaacagcggggaagtgtatgccgcgattcttcagctccagaggatggagcttgggctgcggatggcatcctcgggcatgatccgagccatgggcgacttccgcctgcccgggggaggtgaggcagatcgctaaacccttcttgccctgggtaggcgggaagcactccctgctcccctacatcttccaattgctccccaggaaggcgccccgcctgctggaggtctgcggcggcagcggcgcggtgaccctgggcttgggcgcggggtacgcccccctgcgggtgtacaacgacctaaacgcggatctggccaacctgttccgctgtacccgggatcggcccttggcgctgctcaaggagctggggttcctgcccctccatgcccgggcagacttcgagctggtgctccgcttccttgaccacgagtatgaccccaacgacttcctgaaggatgagctccagattgccgaggactacttcccgcccatggacaggcaggaggtgaaaaaactcctggtgggccgggccaatctgccggatgtacggcgggctgcagcctactatctgagcatccggtacagctacagtgctgccgggaacagctttggcgggcacagcgtggagctgcgccgcttcctcggcctgctccgacgcgcctcggacgcactccggggtgtggtagtggagagcaaggactgctgcgacgtgatccggcagtacgcccggcccggagcggtaatctatgcagacccgccctatctggatgcggaggagatgtacacaccctcctttgccctccaagaccacgtccggctccatgactgcctgtgcgccccggcggtgtgggacagccacattgtgctctcctataacagccacccgggcattctgaacctctttgccccggaattttacatcgtgggttttgagcgccccaaccccatggcccggcaggaggacgccaaataccacgagctgctcgtgaccaattttgatcccagccccatgctcaaccgccagctctccctgttggagctgccaaccatggagtccagcgaccggccagagctgcggatcttgtccgtcccaaccaggcggctgcaccaggtgtgggactggccgcaggactaagaattcgaggtgaaaacaaaagatgaaatttacgatctgccacgacacaagcaagaaaacactggccatcccccgggccgccctccagctctccgggctggccaatgcagagaggctatccctgcatacagggcgcggctgcatcgtgctcacccgacaggtgcccacgatcagagaacggctggagtctatccggctgcttcatgatctgaatgtcggcatggtctgccgtctggccctggacagccggacggccagcggcatgccgtgcaaaagagcgtccgaggtattccgaacctatgacgcggagttcctggatatgcttgagcattgcggtgtagagatggacgggctggcccgtctgttcggaaaggaggctgctgccgatgaatgaggcagttctatactcatattctgcggaagaggcgcgtcaacagggtgagttggccctgtggcgtgccagccatcaggccaacattgcatgcaaaacagccattgagcaggccatctgcggatcttttgacgggatgcacctgaaagcggactgcctggatggcgtactgcgggattttggttataagcggacggcgtgggtgctggccaatacgctccagcagaaagcgtgggacgggcgcttcagcccagtcaatcagcagtggtccagacggacgcacattcccctggatccgcagcacaacagcgactttgtaataggcagccatcccgctgtgttggacggcgccgtcacaatgtaccgggaaagagtacaggcgcttgggctgtttgaggcggagcagtgcctgatgaactccggtgaagaactggattacaccggtcaggtacttgtgctcgatccagatgtcctgaaggaggagttttggacgccccagagccagctctggtatgcctgcgatgggtttggctgcaggccccatgccattggccgctcaatccgcgccatctgcttgggggacggagagactgcaaagtggaaccgctctgactttgtaggcattttgaaggacgagtacctgccggagtgggctgcggccagagtaaaggagctgcggccacagcagaccggcggtatgaagatggaaggaaggtaagccaatgggcttgagttattacacaacggacggaggcagagccagcgacattggggagttttatacgctggaggaagcaatggagcactaccgtggcatcccgatcaccaagcggaagggttttggaatgacggacggcattcatgtgctggagctggtaaagaatgtgcccctactcccgggagattcggagggggaggatgtgctggccatagagctgggggagccgctgcccgcctgggcagacactttggaggcccgccaagccgtccgcacctgtgtggaggccctgggtctccgctaccagatagagggcaaaatcctggcacccatccccgtcaacaaaaagcagcgacgcaagaagctggcggggaaatacctctggcccgatgtgcccgacaatcctgcctccgccctccggtgggtgtacctggcaggcaagggctggctggcccccacggtgcttacggagcaccctgccgtgcgccctctggtgctcaaggtgcgggcggacggcatcacggacaaaggcgactaccgtcctctggagctggagccctgggagttccgcctcctggcccggcgcaccctggagcggctggagcaaaatatgataaaatgtgaaggaggaaccccatcgtgaaacgcaccattctgagatgcgccgctggcctgctcgtggctgcggcgctgctccccaccgccctggcagcggagcccttccctgaagaacccgaggtgcaggtctgctatcccacctccgtcacacgcagtgaggacgggacggagatccgcaaggtctatgatctctccccggagcaaaaccctgccggtatcccccggtcggacttcgagcaggacggcttccactacaccctgacagacctgctccagcaggagctgccggagtacgagagccgtcagcacacggaaacggtatcgttggagagtaaaaacaaggatatggaatccgtcctggccctgctgccccaggagaaggagttcgtcacagaggacggcctgtccggcaccctgtccctccagctggacactgtccaggtggcggcggcgggctacggcagctccacccgggaggtgtctgccacccgctcctaccccaacctggccagccaggataccgccaacattcccaagagcatcgaggaggacgggcgcaccctcaccctccaaaatattgactggcggacggacaacaccgccagcgtgggcggttacgccatgggggatcgctacactgccgtggccacctataccggcaccgccaccaccagctatgtcaccggctataccgttacggcagactacaccggtaccgtaagccgcatcgccctgaaccgggtacgttacgttgcaatttttgagggggaacccctggaacccgccgtacccatggaggagcctggggacggcctggctcagttcaactgggcggccatcctgctcccgctgggcgtggtctttgctgtgggcggcgtgatcggcgcttgcctgttcctcaaacggcgccgggaattcaaagaggaggatacggaatgaagaagctgatcaccctgtgcttggccgcctgcctgacggcggccctggccacaccggcgggggctttagattacgccattgacgcgccagaggggccggactacggcaagtccacctcggtggaggtggtacatacggcagatggcggggccctgaaaaacgaggacatcagcaagaatgccgccctcatcccgccgggcttcggaagcgccagtgcggatagcatgatcaccggaacctggcttacccccaatctggccccggagggcatggcagtgggcgctgtcaacggtggcgggatccccatcgtgtttccgccctctgcggatgcctccaccatccttcccgcagagccggagcagggaacgggatccgccacactgggctataccccggtgacgtcggatctctactactccggcggctacctgggcaccttgaaaatcccctccattgacctgagtgtgcgggtctatgagggcacggacagcagcacacttgccaaaggcgcgggccacttcgagggtacaagtatctggaatggcaacgtgagcattgccggtcacaaccggggggtacgggatgattttggggatctccacactctggagcggggagataccgtcacttggatcaccaagctgggtacccgcacctatgaggtcacttcggtggaaaaggtcagggagacgaacaccagcggtacggctccctctgccgagaatatgctcaccctctatacctgtgtacgcaaccagcgggaataccgctggcaggtgcgcgcggtggaggttgtgtgatctgcccgagtttacgagctgattttctccaccaagagcgattctttactgtagactttttcccgtatttccggtatgttgttcctgtagggagcacaaggacagcagaggaaagaaggaggtcaaccgtatgaaaaggaaacagcttattccagcagtattggcaggcaccttgataggcgcagcactggtggggcccgcgtcggcagaggtggccgccctcactgcagcaccaagcacccagaccttctatgtggacgggaaacaggtggatctggaagcgtatgtcatcaacggccacaactatgtacagctccgggatgtcggccgggcgatggacttcggcgtaacgtatgaccaaggcaccaaccgtgtcctggtagacaccaattccccttacacagaagaaagcgcggcacccgctccctccggggtggtcaccatcccccagtcggacgagcctctccagctgagggagggggacaaggtgctctgcgacgacggcaccacctatgagattaccgatctggagttatgggagtccccggctccgctgcccacaccgacttgtgactggaaccagttcccagagctggagctgcctcaagttgctgttcataggttccatgatcaatatggcgacgatttacatatcttaaatctctatgaaacccgccggatgctgtataccctgtataacgccgtacccaactgcccggagttatgggaggctggaacccttaagctcaactctaagggggatcccatcctacgcctgtctatggggattacagagtccagcggtgtgcagacgttctggccctggcgggacgaacagctcacccgcgtcttctactccgccccaatggcacggtttgaggtagaagcttgggatgtataccacaatgggaaatatctgtacacagaatataaggtaatgggtatgtaatgattcaaagcagaagaatccgtctgtgactcaacgctccgaagcggccgatataagccgcttcggagcgtttctttgctctttttgatattcaaggaggaaatgctgtgaaaaagataatatcgttcatgttgacaatcatcctagtcgtagggatgttgcccatatcagctgtggcagcctccacgccggaggaagcactgggagaggttaacatttatagtggtggatattccatgaactatctggctgtcaatggcaaggtgcagacccagtcgtacacctattttctatatcggaacagccagggagaaacccaagagattccagcgtactgcgtcaaccccaaccagtacggcgtaccccaaacggttcctgagggggagagtatccgttatctggctgaggagaaggccagcgatcccaaggtagtggggctgattgccaatatgtacccccaccgttcactggaggaacttgggctggataacaagtatcaggccttttacgcaggcaaaatcgcgctctggtgctatctgatcccagagtgggatatccacaatgtcaccgtggccccgggccttaccggctcagaacgcacaattggagaaaagcttctggatgctgcgaccagaatttatacacaaggtatgacttgggatcatgtggatgagccccagattacggtcaccccagaccaggagcaggcgtaccccgttacccttgatggggaagcatatttccaacaggtatttaccgccacctcagatacctgggtcgtaaaccatatcgtcaatatccagtttcaaaatcctggtgacgtccctgatggtaccagaattacagacatgaacggacaggatattacccagctcgaggtgtccaacaccggagacggctacagcggacaatttaaggtgctgtatccggcggccagcgtggaggggcggagcggcagcgtccagctgaccctctctgccgatgtctatcgctacgctgtttattatgctctctgccaggaaacggacgaatatggcaatctccagagctatctctgtgataccgatccccagaccagcctgctgcgtaacgccatcagcaattacaactcagagccagaaccggaaccggagcagactgccctcaaaatcaccaagtacgaggccggtaccaccgtgaccctggctggggcgaccttcgaggtggtgggtccggacggggacactatcggcatctataccacgccggagtccggttccatcaccatccccctcactgaggtgggcaattacaccatctatgaacgagtgcccccagagtatcacctgctggatgaggagccggtcaagcaggtcaccgtaaaatatggagaaaccgccgaggtggactttgaaaatgaaccctacggcgacctcaggattgaaaagatcgacggttccaccggggccagcctggcgggagccaaaatacagatcaagcacatcgaaagcggagccacctattccggcgtgaccggaacaggcggctcttatacgtttacaaatctgaagccgggggcctatgaaatccaggagctggccgcgcccgaggggtggcagcgagacccgcaggtccataccacgacagtaatcagcggggaatgcgtcccctataccctgaagaatgaggccctgcccggtctgaagattatcaagtacgaccgtctgagccatgagaccatgtccggcgttaccttccgcatctggcgggacggtgagctgctgggggactatgagacggacgccctgggagaaatcctgctcacggactgccggccgggcacctaccgcgtccaggaggtggacaccggggacagtggccatctggtggattccacaccgcaggagattgagctctctgccggggatggcattaagaagctgtacttcttcaacgaccagaaaccgggcatctggctggtcaaggtggacagcgcggatccatccaaggtgatccccaacgccaaattcagcattgaggctgtggccggcagctttggcccagcagagttcaccaccgaccagaacggcgaaatcgacctgtctgagctggagccgggggcttatgtggtgacggagctggagtgtcccggctacatcatcgaccaagctcagcgcatcatccagctggaggccaacgagacagcccgttttgtgttcaccaactccatcaagccctccctacacctcatcaaactgagttcggacggcgcccgactggctggcgtcaccttccgtatcgccaaaattgaggatggcgcccactacctggatcgcacgaccaatgaacagggagagatcctgatctccgacctggagcctggcgtttactccatccgtgagacggccacattgggggatcatctgctggatcctaccgagcatcatgtggagctcttccctgggcagaccagtaccattgttctggagaatgaccgccgtccgtccctgaccatccataaaaacgacgccgataccggagagccggtagagggcgtcgtttttacggccaaagcggctgacggcagtactgtcaccgaagtcaaaaccggatcggatggcacggccacgctggagcatctgctgcccattgtgtatgaagtaaccgaaaagtatgtccccgaaccctatctactggatgcccccagccaacttatcacgctctatccaaacaaggacagcgatctctattttgtgaaccacaaaaaaccctcgctgaccatcgaaaagatcgacagcatcaccggaaatcccatcaagggggcaaagtttcaaatctggtatgcgtctaactccaccgaaaccggtgaactgaacgacctgggtacctactttaccgatgagaacggccagattttccttgaaaacgtcaaggacggctggtacaaggttacggaactagagccggcctccggctatcagatcaaagagccggctacccaggaatgcttcattgaggccggggcttctaagaccttaacctttgagaatacccctctctccgcactgattgtctacaaatatgattctgtgactggcgaagcggttgaaggtgccgtatttcaggttaaatacctgagtggcacctccggtaccggtgggacagttattggaacctataagaccagtgtgaatggctctttcacagtcacaggactggaggccggcacttacatagtcgaggaactggccagtgacagcggccatgtaatcgacacagcaccccagaccgcctacatcagcggcaatgaccaagatgtggtggagttgtattttgggaattctcccaaaggcagcctgctgatcaaaaagattgacgctttcacccgcgaacccttgtccgacgtgcagttctttgtgaccgagagcgacggcactgtggtaggcgatggcaacggctactttaccaccgactccgcaggcaccattctgattgaaaacattgatcctggcaccacactgatagtcaaagaaacccgtgcaaaagatggtttcattctggatgacacaccccagactgcagagatcaaggccggacagaccgttaccctggagttccgtaaccaaccaaagggcagcctggtcattaacaagttggattccgtgacccgtaaccctttggagggggtggagtttgagatcacctactccgacggttcctatgtggacactgggaatgggagcctgtccagtaagggattatactataccgataaaaacggacaaatcatgctcagcggcatcacaggcacggtggtggttacggagatcaagaccatcgaaggttataccatagacgaagaggcccgcacgcagacggtggtcatcaaccccaatgatacccaaacactaaccttctacaacacgccgtcgggcagcttccagcttatcaaggaagacgaggacagcggaaaacgcatcgccaactgtacatttgagatccgcagattgaacgacgccctggtgggcacctataccaccggctccaacggcacatttacggttgatctggaggaaggcagctactatgcggtagaagtgaaggctaattccaaataccgtctggacgatactccgcattattttgaagtggagaatggagagacgaccacactccgggtcacaaatgaacgcctgagcggtatcctgctgcacaagattgacagcacaaccggcgagggcatccccggcgtgtcgttcatcctgtacgacagcggccataaccccatcggccagtacacctcggacgaccggggatacgtattgatcgaggatctggaggctggccggtattatctcagggagctggagaatgagggctacgttcccgacacagagaaaaagaccgtctatgtggagtccggggaaaccaccgaggtggagtgggagaacgctcccatcaccgggcagatccaggtgaccaagacctcagcggactacaacagtgtcaacggctggcctgccggcacccctatccccggtacggagtttgagatctacaatgcccggacgggcaacttggtggacaccatccagacggacaagaacggtgttgcatcctcccggccgctccctctgggccgctacaaaatcgtggaatccaaggctgcggacttttacggcctggacaagacccccattgaggtggagattgagtttgccggacagatcgtcaaggcggccatgaccaacaagagtctctacaccaacgtatccatccaaaaaaccggctatgtggaggtcatgcctggccagtccatccgctatgacttcgccaacatcgccaacaactccaccaccagcctcacctcgttttattggcgagacactctgcccagccaggcggtgcggttggacaagatcgtcaccggtacctacaatgtgccaggcaattataaggtggtctacaagaccaacctgagcggcggtacttggcgcaccttggcggacaacctgagcacccagcagaactatgtgctggacgcctccagggctgccctgggcctggcctccaacgagtacatcaccgagttcatggtgtccttcggcgtggtacccgccaacttccggcaggtggaggcaccccaggtctatgccaccgtctacgcatggctcattggtggcagccagttcgtcaaccaggcggatgtgggcggcgtctgcaacagccagtggatcatggccacctcccggtgggtgaccaatgtctacaggccatcggaacctctgccccgcacaggctactgatttcagtcaatcatacccatgagggccgccctaatcgggcggccctgctcattatgtggaggtgtatcacatgaccctgaagaaaaagtgtatccgggggctgctcctggccctggtggtggccgcactgtgtgttatcccggccttcgcctcctctgccggcaacgtggcggacgcagtggagcagacttggacggatgccgcaggccagatcaagactgtggtggataccgtagtattcccagctctgagcctggtgctggccatcgctttttttgtcaaactcgcgatggcgtattttgactaccggaaacatggccagtttgagtggacgggccccgccatcctttttgtctgcctgatcttcgtgctgctggcccccaactacatctggaacatcgttggcgtgtgaggcggtgacagcgcatgtttatctgggactatgcggccaaccctgtaatggagtccatcatggactggtgttacagccagatagtaggattcctgggcgccttcttcgctcagatgggcaacatgggggtagagctgttcgatctttcctgggtacagtcggtggtgagcttcttctcccagttgggctgggctctgtttgccgtcagtgtggtggtgtccgcctttgagtgcggcattgaatacgcctctggccgtgggaacctccagcagccagcttttaatgccatcaagggcttcttcgccgtcagcctgttcaccactgtgcccgtccggctgtacgccctttccgtctccctccagggtaccttcgccatggaagtcacaggggcggggaaaagcatcggggagctgggaaacgagatcctcaccggccttgagggggctggcctgatggacatcgcggctcaggccaagtggggtctgggcaccaatcccatcatgctcctctttaccatgatcctcatggcctatgcggtaatcaaggtgttcttctccaacttgaaacggggcggcattctgcttatccagatcgctgtgggttccttatacatgttctccattccccggggctatacggatggcttcacccagtggtgtaaaggggtcattggcctgtgcctcaccgccttcctccaggccaccattctggtggcgggactcatggtgttcagcgacagagcgctcttaggcttgggactcatgctggctgcgggggaggtgccccgcattgccggggccttcggcctggacaccaccaccagagccaatatcatgagcgccgtctacaccgcccaggccgccgttaatactacccgcacgatcgtccaggcggcgacaaaatgattacgctcggaagcctgtttgacggcatcggcggctttccgctggccgccatacggcaggggatcaccccgctgtgggccagcgagattgagtccttcccaattcaggtcacgaaacatcatttcccggagatgctccatgtgggggatatcaccaagctggacggggcaaagctgccgccggtggacattatctgcggcggctcaccctgtcaggacttatccgtggcatcctgtacccgcgccggactggccggcacgcggtctgggctgttcctggagcagattcgggtgacaaaggagatgcgggatgcggatatacgacgagggcggacaggcaagtctgttcgccccagatggctttgctgggagaatgtccccggcgtgttcagcagcggcttccccaaaggggaggacttccggctcgtcctggaacagatcgccggaattgcaggcaattccatacctttcactcaacctcacccctggggctggcaacctgctgggaaattacgagtgggagctgcattctccctggcgtggcgggtcttcgacgctcaatactggcccggcaccccccagcggagacgcagggtgttccttgtcgcggattttgcaggacaatccgccgcgaaaatactatttgaccaggaaagcctgcctgggcattctgcgcagggcgaagaagcggggaaagcctctcccaccccaactccatgcggccctgctggtgcaggcggggctgatcagtcaggataatatatcaccaggcaaagaaacatctggtcggtcttctcttcatggaaattgcctgacgccttgggacactcagcgggcacgtatttttactccagacagcgtcgccccaacggttgccggggcggacggcggcggtgggcgcaatccagctgggcttctttttgccgctggtttcttggcgggacagggctccgcagccagagggatcggttatcagccggagtgctccccaacattgaaagctgcggaaagcggcagcaatatggttccctccgtcctctgcctcaatgaccagagcggcagcgcgatggactgttccccaaatatgtttagtaccccaatggggctcgtgaggacgaaggaacagagacatcagcccctggtttttgagggccacggcattgacagccggtacactgggccgcatccaatcgtgcccacactatccgccagggctggtaccggcggcaacaacctgcctctggccctccagccggagccaaccatgtgtatctgcggcaatgccattgaccggcagccccgcaatgggggcaatggcatcgggattcagacggatgtggcctataccttgaccggtgcagaccggcatgctgttttccgccggcagtgggtggacaagttcagagaggggcagagtgcttccacccagagtgcccgtcaggggaaggacgccaccgatctgatctgtcagccaagccgtgatacaccagcggttttgctgatccgacgcctcactccattggagtgtgagcggcttcgggggttcccagatgggtggacagacctgcccggcgcctcggactctgcccgatacacagccctgggcaacagcgtggcaatcccctgtgtggagtatatcatggccggaattgcctgggcggcggagggggattagcactgttgcttatgcttggttttcggcgagatctttgttggtgttggtcatagctatttgccggtgagatcggtatacttgtgttaccgtaagaggaagggagttgcgatatggaagaaaaagtgaagaacctctgtgctcccatccccgccgggcttcatgcccgggtgcgggaggagcaggaggcatccggcaaaacactgggccagtatatggcctggttgatccaaacattttatgagaatcaagttaaggaggaaaacattatgatcatggacaagagaacggtagcattccaggtacccggcgagctgttcgagaagttcaaggcctacttgcaggagcgggggatcagacaaaacgccttcttcctggactgcatccacagggccctggcggaggcccaggaggagcgggtggatgcggaggccgacaccaacacaggagacgggacgcacctcccggaggaggcctataccccggaggacgacgctgagcccgaaggagaacccgacggaaacgagggcgtggaagaaagcagtacagaagaatgaactacaggaagggattcggccggactggccggatcccttcctgctttggaggtgttttcttgttcatctatccagataacctgaaggctaaggccaccctgtggctgtggcaattgcgggatgtggctgtcattggggcggcttttctcctctctgtattggcgctggctcaagccggtaccatgctccccctggtgggtacggtgctgtatgcattcctcaccatccaggtggagggctccagcgtcctagacttcctccgccgggcggcctgctttctattcctgcagcagcagttttacgaatgggggcaggaaccgtgacgcggaaggaaaaattactcctgcatcaacgccagaccacccgtcagctcatgggtatcacccgcctgacggagcacggcgcggtgtgcagccgggacgagctgctcttctacttgctccggccggataacctgtccatcctctccccagagggcatccggggccgggtgcgggccctgaccggtctcctccaggggatgacatccctggagctgctggccctggactccagggagtccttcctgaaaaacaagcagtattaccagcggcggttggaggaggagccagagcccgccctgcgggagctgctgcggcaggatatggagcacctggacgcacgccagtcctccaccgccgcctcccgggagtttgccctggtctgccggctggacagcaaggccgcggaggatcgggagctgccccggcgattggagaagcagatccaggatcacggctttcacgtccgcctggccggggaacaggacgtgaagcgcatcctggcggtgtactaccagcaggacatggtgaccgaacactttgacagcatagatggagagaggtgggtaaccgagtatggctaaaagtcagaagatgcaaaagaaacctgcggagaaaccagcgcagctcttccaacccaaggacttcctggatcggatcgccccggcggcggtcaagttcaacacggactcctatgtgctgggcgggctgtaccgctgcgtcctggccctccggggctaccccgccgtcaccgaggagctggccctgctcgcccacgtctgcaaccgagccggtatcgccctccatctctatacccgtcaggtgacagcggcggaggaggaggctatctaccacaaggccgtcaacaagctccggctggatcggagcaatcaggataacctgaagcggagtgtcacggcggaggccaacctccaggacgtggctgccatcattgccgccgcccggcagaaccgggagcccctcatccactgcgcggtgttcctggagctggccgccaaaagccccgaggagctgcggaggctgcgggatgaggtgggcgccgagcttacccgggcaaagctcagtgcagatcctctgctcctccgtcagcgggagggcttcctctccgccaacccggtgggccgcaatgccctgggcgcccggtttgagcgggtgctccctgccagctccacagccaacctgtaccccattaactactctggccgcagcgatccccacgggttttacattggtaatgaccactacggctcggacgtcctgctggatctggatcgccgcacaccggacaagaccaattccagcgtgctcatcctgggcaactccggcgagggcaagagctacctgctcaagctgctcctctgcaacctgctggagagcggcaagacggtgatctgcctggatccggagcaggagctgacccggctctgcgacaagctggacggctgttacgcagacctcatgggcgggcagtaccgcatcaacttcctggaggccaagcggtgggacgttggcgacgacagggatgacgatccaactgcgcctaatgccttccgccagcggtcgcccctgtcccagcacatctccttcctcaaggacttcttccgggcctacaagcccttcacctaccagcagattgatgccctggagctgatgctggagcggctgtaccggatgcggggcatctcggacaagacggacttctccgccctggagccggaggactggcccattgccgaggatctgtacgccgtcctggagaacgcctacgagcactatgactgggaggacagccccctgtatcccagggaattgctgcgggagctcctgctgggcctccactccatgtgccggggggcggagagcgtctacttcaacggctacacaaacatcaccagcgcccgattcctggtatttggcgtcaaggatctgatccacgccaactcctccgtcaaggacgccctgcttttcaacctgctgtcctatctcagcgaccgcttacttacccaggggaatactgtggccgccttggacgagctctacctctggctgtccaacctgaccaccatcgagtacatccgcaactgcctcaagcgggtgcgaaagcgcaattccgcattgattctggccagtcaaaatttagaggattttgacgtccagggtgtgcgggagctgacccgtcccctgtttgccatcccaacccaccagttcctcttccatggcggcaaggtagaccggaagttctacatggataatctccagatggagagcgccgagtacgatctgatcagctctccccagcggggcgtctgcctgttcaaatccggcgcggatcgcaatctgctggacgtccatgccccgccccacaagcatgtgctgatcacaggaggagatggatgaacgtggtgggctatggcggcggaacaaacagcacggccatgctgatagggctttggcagaggcgcattccggtcgaccttattctctttgcggatcccggcggggaacagccccacacctattcctatctggaaattatgagccggtggctggcggaacacgggatgccgcccatcacccgggtgtggtacaccacccgggacggccagcggctcactttggagcaggagtgcctccgctccggttccctcccctccattgcctatggccacaaaaagtgctccctcaagcacaaggccttcccccaggagaagttctgccggcacgatccccgctgccgggcggtatgggctggcggcggccgggtgatcaagttcatcggctatgacgccggggaaccggagcgccgggagcgggtgcgggagcgggacgaagcggacagcaaataccagaaggaatatcccctcatggagcgggggtgggctcgggacaggtgcattcaggccatccgggaggctggactccccctgccggggaagtcctcctgcttcttctgtcccagcatgaaacggcgggagatccgtaccctctaccacaaatatccggagctgttaggccgtgccctggccatagaggacagggcgcggcctaatttagttaccgtcaaagggttgggccgaaattgggcctggcgggactttctggagtacgataaggggcagctggcgtttccccaggtattcccggaggacaacctgccctgctcctgtggggggtatatcacatgagccccgccatcttagtcaaggctaccgcgtccatccttaccaatgagaaaagccggaaagctgtgggatgggtgctgacagccgtactctctcccgtcattctccttctggccttcttctgtacctccttttcgggaggggcggagcacaaccgcactgtggtggatctgtgctttcacggcggggccataccggaggacaccccggcggagtatcaggcatgcatccaagagatgcgggacagctttgccctgctggatgccgccatgcagaccatggaggggcagatggaggacggggacggcctggatgacgtccgggtcaaggcggtgttcttcgctctgtacttcggcgcggatgacccggcagcccatgctggacagacctttgtggattgctttgtcacctatgaggagcgcacccgcacagtgaccaccgtggatgaggacggcaatgaggtagatacccaggagacctataccgtagccgtcccgatttcagatctccagcaggtctggcagaacctccagcggcttacaggaacggaggtcacaccggagcagcaggccaatgcggacagcgtctacaatatcgtgatgtatggtgtatccaccggcacggagggctggattcccggcgcggacgtgcccttcattggggcggacggcttctgctcccccattggggcgggctgggagagccgggtcacctcggagttcggctaccggcgggatcccttcaccggggagacccggggccacaccggcatggatttggcggtgccgaccggcacccccgtccgggccgccctgcccggaaccgtcaccgccgcccagtaccacagcagctacggctactatgtgatgatcgaccacggcagcggcctgtccactctctacgcccacaattcccaactgctggtgcgggtgggccaaacggtggagactggcgacatcgtatctctgtccggcagcaccggccggtctaccggcccccacctccacttcgaggtgcgcgtcaacggccagaggacagatccaagatattatctgccaactacataacgaggagtgagaaaatgaacccaatccagaatacggcttgccttattgccgcctatgaaacggcggcggggctgccggacagtgaacggatcacccagatagatggtacatggaggccaggggtgacggagcagcaggcggcgtcactttaccggcaggcacaggccctgctggctccggaggccaaattgctctccacaagccgtgaggcattgatcgatcaaatgagggacagcctgctggtcagggaactggtcgtgggagacacagtgctctttgccgccacagaaccctacgcaggccccggcgattttacccttcgcgccggcattatccagtccattgacccggaacgcaaaacctgctccgtacggggacgttttttcccgatggatgatgttccccttcactatgtactggggcggtatgatttggacttgcatgagacgcactacggcgtcccctgtgtccggcctctgctgggagaacaccctgagctggcagagcggtatctgagggaggcggaggcgaagtggaatgccagttatgggcagccaacagtcacaacggaggcctcgcccggccccatattgggaggactcgggagatgacagatgagaatatcagggtgctcaaggtggcgcccggtaaagcgccggaggccgtcgccatccccaacaccctggaggctatgcagcaaatggtgggcgggtacattgaggtcatccccctggaagacgtctgcctggtgtgcaatgaggagggcaagctgatggggctgcccggcagccgcagactgggggatgacatcattgccggcaccttcttcctggccggggataccccggacggacacttctgttccctgacccaggagcaggcagaccgctggggccagcactttgcccagccggaggtattccagcccgatgaggtagagaggaagatccatattgaattctacacaatgtaggcggttgtactgcagcctgctggcgttgacactgatatttcttctgcggacgccggcgctggctataaccacaagtgaaatgaacgagccaattactgtccagcagtgggcggccatgctgtgcaagggcaccctccatgagttcgggcactttctggacagcgtcctgggagtcccatctgagagctgcttcttttacgaggcggaggccggggcggcctccgcctttttgcgggcctacgcagggacaagctgccgggaatacttcgcggattatttttcttattacgtgaccaactacgatgatacagaaaaggcggcgcagatggagcgcctgacgctggagacctttgcgtttttctcccagatggaagcaggcggctggcagctttaaagcaggctgaatgactaatgatggaggtgaaccttatggaaaaaacggaactgacggtgagcatggaaccggagcggctggacgcgctccggtattttcttgccgccaagaacaaacgcacacctcaggtagagctccagcgtgcgttggaggagctgtacgagacctacgtcccggcggagacccgggcctatctggatgccaagtgccgtccaaaccggccgcgccccagacggacagctgccaaaactgcccggcagcagagcgcggagccgctggacggcagcggctccgcgcaataatgggtaaggagtgcggcataatgaatgtgaagcgattgtgtggattcgctcttgcgctccttttggccttccgctgtatggccctcccggccgctgcatcaggccggttcgctgatgtgccggcggattctgtgtatggtgaaagcgtagcctacctggtggagcacgggattacgaggggagcagggaatcattgctactgtccggagcggcctgttacagtaagcgaatgggcggttctgctgttcagagcgttggacggaagcggcctggacagctacccgtcggataagcaagccgagttctgtatccagcagtgctatcaaaaggggtggctggatgtgcgggaggtcttgtcgcctgagacggtgctctgccgtggaaacctgctgctcagcgcctttcgtgcgtttggattgccggtatacgattccacgctttatggagatgcaccaatgtcgcccctggaaaatgcgctgcgcgttggccgagcgctggagctatgtccggagggagcgtccccatccgaagaaatgacccgtggagatgctgcggtgctgctgcacaccctcctgacccaaacgcttgaggttgccacccctccgctgctcaatgagctggatatccaggctgagtcctcagccgatctcaaccgttttcttttggagataaaccgggtaccggctcctatcctgcaagccttctgcgcggcgggatgggaatttcatgtggcgcccgcatacatgcaagcctacagtgagcggcgcggtacggactatggcgggcttaccgtctatgcagagaagcggatctatgtatcagcaagcgtctctgtaatccatgagtttgggcatttcctcgcctgggagctcggctttccgccagagcatgacgcgctctattgtgcggagcaggagtccgcgcgcaccgttttgcgggactatgctgtgaccaacagccaggaatactttgcggactacttctccttttggattcggaattcggacgacaagtcggaaatggaacggctcaaggcagcaactccgcagacctatgcgtatttcgccgccctggaagcctgcggctggacaggcagttcgtaaccatctgcgggaaggatgggctgtatggttcaggggtgcccggctggttgcctgcccagagccccgtgcgcgccctgtgtgccggtttcaggcgaagagagggcagggctccgcctggccgaaaaccgccccgttggggccggtgtcgccctgatttggggcgttcgattttagtactaggataaagaaccgccgtggtgaaccccggcgctccggccacaaagccccgcagtgcggggcttttcccaggttcaggtaccgccgtcggtaaaggcccgttccggggtttggagcggtggtacgtttgaaaaagcacggtgttgtaggggcttgaggcccttttgcaccgccgtggcgaacgaggaggaagcatggacgaggaaaacaggctgaaaatcaccctctggctcaagccgggcatcgtccgccggatggacggctggctggaggaggacaactgcaaaagccgcggggagtttgccgaaaaggccctgcggttctacatgggctacctggccacggaggacacctcggagtacctctcccgcgccctggtggacaccctgcggggtacattggcggacaacgaaaaccggctgcgcaccttgttgttcaagctgtgcgtggaggtgaacatgatgggtcacaccgtggccgcccacttccgcgctgatccggtaaaccgccgggagctgcgggcctttgcagtggacgaggtgctgcgcaccaatgggaagatcagctttgacgacgcgctggatctccagcgacaggtctaccctgacggatgagccacatccgcttcatgtccccctacctgaagggcggcagagatgcggccaagctgtccaaccgaacccgctacatcgccacccgtcccggcgtggaggtgctcaggggtgagcacagtgaacagcctgcaacaaaaaagcagcaggcttatatccaacgtctgctgcgggacttccacggcgcggacgagctgctggagtacgaggactaccgcaatgcacccacgcaggggaacgcaaacgccttcattcgccaggtgcaggaggactttgcggagcccatgagccggatggagaactacctggactacgtgtcccaccgccccggcgtacagctggacggtgagcacggtctgtggtgcgccgggggcaaggtgcgcaacctctcccaggccgtccgggaggtggcggagcacaccggaagcgtgtggacgccggtggtggccatccgccgggaggacgcggagcggctgggctacaatgacgcggacagctggcggcacctggtgtgcgcctgtgcgccggagatcgccagggggtacaaaatcccgctggagcacctgcgctggtacgccgccttccaccgcaaggaggacagcgtccatatccacatggtggtgttctcctccgatcccaaggagggctacctcaccaggcagggtatccagcaggtgaagtccgccttcggccgacggatcttccgacaggatctgctccacatctacgaacagaaaaccgaataccgggacgccctgggccgggatgcggagcgcaccatggcagagctgattgcgcagatggagaccggccagctccaaaatgaaaacctggagcagccgattctggaactatcccgtcgcttgcagaacaccaaaggcaaaacggtgtacggctacctgccgcccacagccaaggcactggtggacgcaatcgtggatgaactggcaaaggaggaacgggtagctgccgcctatgacctgtggaaccagatgcgggaagaggtgtgccgtacctactcagaacaactgccggagcgcctgcttctttccaaacagaaagagttcaaggccgtgcgcaacatggtcgtccgggaggtgcttcagctggggcggggtgagcatcccacagcagatgagatagtacacatgcccacaccgtcgggcacaccgcctgcacaatcgggcctgccgtatggggcacatcacccacagcaggaggccgcgcaccatcagcgtacacagacacatcgggcggtatcccatgcggataccgcccgatgtgtcctccagctgttccacagcatgggccgcatcttccgggagcagtccgcctccgatgccatccagactggcctgcacatcgaccggaagcggcgccggatgctccgggagaagcgtatggccctgggacacaaggccgatgaccatgaggaaatcccccagcattctcaaagataagatgggggactgccattgaactggtagtcctccgtggtttcttccgctacttcggctccaggaatcctatgaccatatctaccgcctctgaggagatatcctccggagcacgctccacaaaggaggcatggcggctgttcagatccagcatccgggcctgatcacacaggatgaccccgtccgtcctggtacgctcatccagccggaggtggaacgggtggccccggtctgtgtgggtgatggggcaaaccatggtcaggctgctgacccggttgaacaagttgttgctgatcaccaaggcaggacggcggcccttctgctcatggccggactggggatcaaagtccagatagacgatatcaccctgttcaaaaatcgtcaccatgcctcagagccctccgccttcccccaatccagctcttcggcctcaattcggtcgatctggtcaatgggctttccgtagaatgcggtgaggcgttcctccagggtgcggtgcgggatggcagaggcacgccggatattgataccatcatccatctgcaccagttccacccggtcgtgttctttcagaccaactgcgtccaggagggccttggggatccgcaggccctggctgttgccccatttttggatcgtcgcgtacatgaacgacacctgcctttcaaagatagtatatacagagtataaacaaaagtcaaccgtttgattcgaggtgagccagcatgggaacctatatccattttaccgatgaacagaaggagcgggccaactccgttgatctggaggaattcctgcggcagcggggggagaaactgagccgcgccgggcgggagtcccggctggccagggtgcaccatatcaccgtccggggcaacgaatggtacgaccatattgcccggcagggcggccatgcggtcagctttgtccagcactactacgggacaacctatcaggaggccatgaagctcctgctgggaaaagagttgggggaggcatatcccgccgcgcagccaaagcgggaggagccgcccaggcccttcgccctgccgccgccccacaccgatatgcgccgtgtgtacgcctacctgatgaagcagcggcacatcagccgggaggtggtcacccactttgtccgggccggactgctgtacgaggacgcccaatatcacaactgtgtctttgtggggacagacgagcagggcgttccccggcacgcccataagcggagcacaaacagccagggcaaatccttcaaggtcaatgtggagggcagcagaccccagtacagcttccaccacgtgggacaggacggcctgctctatgtgtttgaggccccgattgatctgctgagtttcctcacgctgtacccggacagatggcaggagcacagctatgtggccctgtgcggtaccggcggccaagccatacattggatgctggagcagaacacctgcctccgggatgtggtgctctgcttggatcacgacgagccgggacagacggcggccaagcgcctcgaggaagagttacagggggcaggataccacagcggcatcctgctccctgtgcataaggactggaacgacgacctggtgcaggggccggccatggtcggcactgccatgaccatagggcagagtatgtaggccgcagaggcgcaccgcccgccagggggatggtacgccctgccgctgaaccgggggccggttcattttggaccgcccagaaggtcacactggaaggtaatctaaatacagagaactaactaaaatggtacctatagaaaggacagtactctgacaaaaaagcacgaaagacagaccagagattgacagtggtacacagaaaatagacagtagtttgacaaaagagtaaacgctgtagacactgccttgacagaggtcaagatcatcgtgcaaaataggacagaggctatgggtggaaaatggctgttaaatttgttcccaaacggtattcgcctgaagaaatagaagccctgaaaaagaatccaaatgtgctggaggtgcgggaaaaccgtttgctgctgacaatagagttcagacagcaggtctatgaggcgtggatacggaggccagagcggtcaactgtcagaaggatgctggaggcaaacggatttgatacccagcgccttggcctaaacttcacaaagtcagtggaatctgtttttaaacggggtgggcgtccgaagttttcaaaggcatcgccggaaacccaggcaaactgggccaaaacaatatatatgccaaccatgactgcggaggaattggttgaaagcggaaaatttgtttgggatgtcaacagactgattttacatccggattttgaggcggagctataccgaaactatccccaacagtccatagaagatggtttgctgtccgctgggatttcgccagcagacatgggctaccacaaaatatactggctgcaagaaaaatttgaacattcatctgggcaggacacaaaccgcagtgctacaaggggccgtacagcttattatactgccgccacggtagagcagtatcgtaaacatccttatgtccaaacagccacccgtgaaaaaatagagttgaataaggcattctttgaggctgccgcacctattgcagtactggcattcgacgacatcctccgtgtgtttgatattgacccggagatattttcagtaacggagcgatatcgcatgagccgagttttggctgcatgggctacaccggctgacggagagacaataaacgcctctcccacacggaaaatccttagaaataggatgcgggcattggacagtattgtagaaaaagggtttcttcaaattggagatattgtttcttctctgaatgttctgcagaagaaatcgctctgcctgtggctccgggatcttccgccagacccaggaagaaagtatagcgttagaaaaatactctctctcatgaagatttctcgtgcgtcatattatgccatactgaagaatggcacctatggacagtcggtagtacagagaaacgcacaagacgagcaggatgccgaactgattcgaaccgttatggaatacaaggggtttgccaaaggctcaaggcagatctatatgatgatgccagctctgacgggaaagcgtatggggctgaaaaagatacgccgtattatgaaaacgtacaacctcacatcgtcgattcggaaggcagcgccttccaagcgcatgggtggagcggcactgaaaaagaatgtgagacctaatttgctgcagcgcagattccgcctttaccggcccaatgaagtacggctgacagatgttacacatcttctctatggcgacggatgcaaggcatatggctcagcactgctcgatcccgtcaccagcaagttagttgcgtttttagtcagcgaacacaatgacttggaactggcgcttgccacactgcgtcaatcagatcttcacccatgtgtcagcggtggactttatcattctgaccaggggacagtttatctgtctggcgcattccagcaggaagtaagcaaaagaggttacacacaatcgatgtccaaacgaggaaattgccaggacaacgccccacaagagtctttctttggacattttaaagatgagtgtccgtattcggaatgcaaagatatcgaggagttgagggaacttgtcgcgcgatatgcagagtattacaattatgaacgccgcatgtgggataagggccgcatgacgccagtcgagtacgagcagtatcttctggccatgaacgaagctgaattctcgctctacatcgcaaaggaagaagaaaagtatcagcagatgaaagaaaaagctgcccaacgagccattgaacgggcaaaaaatttaggagtatgagaaaggtgggcggatgagggaatatgaaacaaaacagaatgaccaggcagccgccagaggagattcagccgtttctggataatccgttcctaaaggattttcgtgggcgggatattatttacacgaaggacttttatgttgccatgtataagaagatctccgaggagcatatgacctatgtggcagcgtataacagccttgggttttccaccgctgtactcggagaggaccgcgcgaattccgcaggaaagcgggcgatgcagttgggccgggagggtcgtttgttcaccgcagatccctccagctatgatggctctgtacccagagaggctatgggggccatgtcccctctggaagaactggcctatctgaaagccagaaatgcctatttggaggagctggttgcagctcaaaaaaaactccgttccgcattggaggacacaactatatcattgaatccgaaggtgtaagcgccgaccgtttctatatggtagattcctttatccgtagacaagcggatagagcggacggtctgtctatcgtgcaatgccttcacatatttggagtgtccagatccggctactattcgtgggtcaggcgtaaaaaagatatagacagctcctgtgccgcaaagaaagaacaacaggagcaattgaaagaaaagtttaggaaaatcgtgagaaaacttggatatgttccgggaaaaaggacctttcagacccatctatggcgcgagttcaatatcagtatcagtataaaacgctgtcgaaaggttatgaaagaaatgaatctcgtggccaacagacccaggaaggacgcttataagaatcaggccacacacaatcacgaatattcctccccgaaaaacgcggtgaaacagaatttctccgttggtccccgcagagttattttgacagatatcacttatttgtattatggccctgtgcgtacaccgatttatctttgcgcttttaaggatgcttatacaaaagagatcttggggcattgcgtgtcctcccgcatgacagtctcgcttgtcaagtccgcctatgacgttatgatggagaaccatggacacgaactgcgaggtgctgcatgtgtgatccatagcgaccaaggttctcagtacctctcgaccacattccagaggctgctgtcagatgacggttttctccagtctgtttccgataggggcaattctcaggacaatgcccccatggaatcatttttcggacggctgaaatgtgaattgcttgacctcgtggcgctatgtccagacgcgtcaactgtaagccggatgatcagcggctatattgatgcctataaccatcgacattaccaatatgcgctggcggggctaactccatctgaatactacacctatgttaccactggtatctacccggtggacaactactacggcatcaaggcgacagaacttatgccaatccaggcgttgatagccgcccgtcgccgcgcggcagaggagaaggccaaaaagtacagagaggccagcgcaaagaaacgcgctatggctcaaggaaagaaaaaggacccagaattcgtcatagcaagggatcaacgcatcttgcgccgcgaaatagcgaagtggacccgctccaaagaacttgcgcttcaacagatatcccatctgagagaaattcttgaactatcccaaaaagcaagggcctatttgatgaccgcatcagctgacctgattttgcagctatacaatggagaaaactggggagcccatccagaactcgcttatatttacaaaatgcgtgaacttttttaaggtactttctctattcgcctttgtgatacttatcaatgcgatagagtgaacccagtaaccccgttgccgcaacagacttagtaaatctgcaaaaaaaaacaccccctattataagcacagcatggccggcattaatatggcggccatgctgtgcttacgcttccgttctaaacgaagttgggtgattctgtcaaggatatttataatcttaatcaccccatatttagtgctattctacgaatattataatacgacaaaaaacaaatggtcagttggccttcccgtatctttttaacgtgataacgcttaacgcatatttttcaccagtaacggtggttattttgtatctgttactgtcaaaaaattgtccttgacattggaaccagtttaaacaacaagaagggagatggccgctgtgaacaacgacacctggatgctgatcctcctgctggcggtggtattcggcgccctggtcgccattaccaccttttccggccggggcagcctggacagcatcaagagtaaaactgtgggtgacggccagcacggcaccgcccgctgggccacgcagggggaaatcaagaagaccttccgctccgtccccttccagaccgcgctgtggcggaagggggaacgcctcccagacgcacaggggctggtgttgggctgtaccggaaagaaggggcagctcacggccctggtggattcggacgatatccactgcctcatgatcggcgcctccggcgttggcaagaccgccttcttcctataccccaatttggaatacgcctgcgccagcggaatgagcttctttgccagtgacaccaagggagatctggcccggaactatggggccatcgcccgggactgctatggctaccaggtggcagtggtggatcttcggaaccccacccgctcagatggctataacctgctcactctcatcaatcactacatggacgcatgcaggagagatccggctgatctggccgcccgagccaaggcggagaagtacgccaaaatcctctccaagaccgtcatcaacccggatgaggagaactttgcacaaaatcaatatttttacgacgcggcggagggcgtgctcaccgccgtgatcctgctgctggcagagtacctgccacccaaaaggatccacggggagttgcgggaacggcggcatatcgtgtcagtattcaagctggtgcaggagctgctggcccccagcattctgcccggcaagaatgagttccagctcctcatggaccgcttgccggaggaacacaaggccaagtggttctccggctccgccctcaccgccgccgaacagtctatggcctccgtcatgtccaccgtcctctcccggctgaacaccttcctggactcggagctggagcaagtgctgtgtttcgacagcaccatagacgccgagagctttgccgcaaagaaatctgccatcttcctgatacttccggaggaagatcagaccaaaaacttcatggctgggctgatgatccagaccctgagtcgggagctgttctctgtggcggatgagcacgacgggaagctgcccagccgggtggtgtttttctgtgacgagctaggtaccatgcccgccttcgacatcctgcccctattctccgctggccgctcccggcggctgaccctggtgcccatcatccaaagcctggcccagttggagaagaactatggcaaggagggggcggagatcctgacggataactgccaggacaccattttcggcggcttcgcccctaacagccagaccgccgaggtgctgtccaaggccctgggcagccgcaccgtgatgagcggttccatctcccgggggaaggacgataccagccagagcctccagatgatagagcgccccctcatgaccccggatgaactcaagtccatccccaaggggcacttcatcgtcatgaaaacaggcacacaccccatgcagacccgcctgcggctgttcctggagtgggggattacctttggggagccctaccaggtatcccagcaggccgctcgaaaggtctactacgccagcaaggcagaattgaccgatgttatataccgggcatttcctgcgtctgcccgccagaacaactaccgtacgccgaaaaaggagaaaaccataccatgagctattttagcgagatttacggcgacttagagctgagcgccagggccaagctggtgctggtgtacctccatgaccgggcaaacaaggatggcgagagctggtacgccattggcaccatggcaaaggatctgagactttcccgctctacaataaagcgggccctgaccgaacttgttcgtcagggccgagtagaaaagcaagcgaggtttcgggaaaatggtgggtgcacatctaacctttatgtattttcgaagtattgtaagcaacatctgtgatcattatcttcattgaaaagtgcaacgggtttttcaatagttattatgtggtgatcctccaccctctaaagcacaaaaggaagcccccttgaagcttatgagatatcacccatatagattagttccctgttgccggtgagccggtataggcataaaattgggagtcgaatttgttgcgtagtggttctcactattgcctattgatagcgccgaagcttttttaacgctctcatctttacctgattgatattttgttttgttgtatggacaatccttgcaatatcgactgatgtatatccatggaggtagtgttagcgtcaggcgataatcgccattccgggtcaggcgaaaaaggccaattctggtcaaacgaaaaacgccatttacaaattgaataagtcctttacactgagggcatagccagccctcggtgaaaggagaccagatgaaaaaacctaactttcccgccatgcttccagcggtggccgaggtcattgagcagatgatggcggagcagggagacgagttctccctggagagaatcaacctcgcagagctggagcgccgcaccgggatttctcgtgccaggctccgcaggatgaaggagcatgacttcgagagtaccgagcacgcatccaagggcaagaaggcaagcacgaccctcctgagcggctatacgggcatcctggacggcctgctgaaagccggagtgacaaactctgccgtgtgcctgagcaggctccgtgtaaacgggtatgccggaagccagaccacgattaagaactacatcctgtcccaccagcatctcatccctcctgtccgttatgcggttgctccgcagggaaaccgggggcggagatacactacagcccccggcgaggcgttccagatggactggggctttaccaaggttcagtcccacctgggagaagaatactccgccgcctgcttcgccatggtctgccaccattgtggtgagcggtatgtggagttcttccccaacgccaagcaggaaaacctgttcattggcatgattcacgccttccagtacatgggggtccctcagtatgtcctcacggacaacatgaagagcgtggtgatccggcggggcgaggacggccaacccatctggcagagcgactacgagcagttcatgcggactgtgggtttccagaccaaactctgcaagcccaggcacccctttacgaagggcaaagtggagcgtctggtccgtttcgtgaaggacaacttcctggccggaaggaccttctggaatgtgactgacctgaacctgtctgccctggactggtgcgacgagcagaacacctgctaccaccgggggctgggcatcccgcaggacatccaccggaaacggtgtgccaccgttgttgcgaagctggatgaccgcccggagctgctgttctacctttgccctgagcggcggatttcctttgacgggtttgtgaactacgaggggcggcgctttggcgtcccttacagctacgggggcaagaccgcccgcgtgatgcgaagcggctcctgcctgtatatctactccgcagacatggcccatctgcttaccacgcatgaagtaacctggagccactacgacagcttctgccccaaccaatttgctttcccggaacagccggaggagttcccctccatgccggtgaaaacggtgattaggcagctcccacagccgcccgcagacctctcctttgagaagtttaacttcaccaaggaggatgacgaggatgactaattctctgtttgaagcggtggtccatgctacacgggtactgaccaagtacggcctcaccgttgaggagcttgcggcagtggtggagcagaacgacatgtccgatgcggaagtcctcgctgtttccaaggtctttgactgtctgctgacgaagcaggagatctccacagtgaacttcatgctccgcaccagccgcctccccatgaaggtgcccaagacttttgacaactttgatttcagccgcatcactggcaagaatgtggagcggctgcgcagccttcccacgctatccgcactttatgcccgcaaaaaccttgcctttattggccgacccggtacgggcaagacccacttagctcaggcttttgggcgtgcttgctgtgagcacgggtttaggacctgcttcattaagatgacggaactgcgggaccgcatgacctccgcccggagaacgggccgagagagcagccttctggcctaccttgtccgcccggcctgcctgattattgacgaggtggggcactgcgagtttgacaaggagaacacccggctgttctttgacatggtggaccgccgctaccagaaggacggctactccaacatggtctttaccagcaaccgggaccccgcccagtggaaggagaacttctccgagaacgatgctctcctgtgtgcgctggaccgcatctttgacgatgctgtggtctttaccattaagggggagagcttccggggcaggaagctagagacggtttccctgcgcacctcctccacctcccaggctgaagcacagacgaccgtataaactttgccgtccgggggctggctacacttgattggcgattttcgtttgactaaaattggcgattttctcctgacccggagtggttaatttcgcctgacgctaacagtagattagggtaaggacttttctctcctttttagtaagttctggacatgtgtctaagagttcagaaaagtcaagtacttcgcgttctctgatgggtgccactaatccaagaagctgtgcttctgtaagttcttcccaagataccggcggctcgaccgtcttcttgaatggaagcaatgagatgtaagcatttcgtacagactgggctaaataggcgacgatcgtaccgtctccttgagagcgaagcgagtcaagattcatcgcatgtatagtttcaataaaacgcagggttagctcactttgtgcgtcctccgagtgtagtcgtctgctataatgtttgagctgtggttcaaatttctggatgatgaaaagcatgtcttcttggcttccagactgggcacgaagtatacgttcactgaacaccgcttacacatcccatcttcgtaaagatgagagttaaagagcggattgtgccccaaaagtaaacttagtttcaaaaaaatctactttgtacactctattagacaaggaaattccaattatgcaaccagacttctatgctgtaaaatggttcaaaagtaagagagagggcatgagtagactcatgccctctcccctgtaaagtggattcaattgatgaaactgatagtgttgattttgttgcagatttgatgaaagcttgtcttatataaaaacagcaccttctctaaggtatggaatctgccaagtcatatctttgtatgcttagtttgctttcgatttcagaacgatgacctggcacagtaaccgccccgtagtaatctcggcttccgcacagcgcaattgtgtagaagcgccgccatccaaaaagaggcccttccatgcaggatcattggtagcagcggaatccttgagccccagataggactggatcgcgcttctaaactcaacataatttacattcttggcagtcgcgattagatataccttgttcgtatccaggttcactacgattgcactcaagccctcgtgatcgctattgacatcaacggctttattaacaacagatacccagttctgattaccaagagacatcgctacgccgccctgagcccaggctctcgaatttcccttaacaccaggaagatcctcataattagtggcctccatatagcccatataactgccagtgtagaagatggcatgcttgccgactgtgcttacgcttccgtcacggggttcatttttattgttcactcctccgccaacaggacggccgccactaactgcaatgtttagaatattgcaattattatcatcgggtttcgtactggtgtaccacccgccattgattccatactcattggaaccctttaaattagacgtcttgagcagctgaacgggcctaatattgctggcatccgtctcaataatgtgtaacgtcataccattctctgtagctttatgataggtatacatttcttttcctccgttaaaataaacagattttgatgtcttgtaagcgcctacgtaatatgaaagaaattgttgcccgtgaaaaataaactagaaacaggaggctactatgaaacttcactgtcgcttgaaccgcctttggtgcatcctacctatgtgtgcttttattgccgcattttttatcggatgtaccatcagccggtcagattccgttccgtcttcttcgtccgagccgctgcccgcggccacgccggctcccaccccccggacactgatggaggggatcacccccatgcccatcgcctccagctacatgacctactatgcaatacagacggacggcacactgatcggctggggagaaaatctgcgcggactgatcaactatccggattctttaccgagctatgaagatgccgttgtcatgatggaggatgtggcagccgtctatgccggggattgggtcacattgattttgtgttccgacggcacactctggggggtgggctccgggctgttcggtcttttgcctgaaagggcggcttcgcaggatgcgtatgaccctctctttctgatgagcgacgtggttatggccgccgtttcctccgagagcgcctgcgcccttcgctctgatggcacggtgtggagttggggcggctcggagggatttcagccggaacagatcctgaaaggtattgtaaagatagcggcatattccagcggccactatgccctggacatagacggcaccctctacgtcttgggatcgctcctgcctctggaagtagaccggaacgaatgctggttgactccccagcctattttggagggcgtcacagacatggcctccactggtcgccggcttctggtgcagaaaggggattccagtctctggcggatgggctggtgggaggggtatcaatatcagccgctggagaagtggatggacaacgtggtctacttcactgcggatctcgcagttaccggggaccacacactttggtacttggcctcagataccccaagcatgatcatgaacaatgtggcctgcgcagtaaatggtgaacaaggaattttagccctggactgggatggcgggctttggctgcatccccaggagggcgacggctctgccgatgcggtacatctgtgcgatgatatttgggttccagagtcttggtattcacagcagcaatcccgcaatacggattaaggaaactgcttaagtatttgaaagcccaataaaaatgagatcgcagaatggagaggagagtagatttatatgagacgaaatgcagcctttgcaatcctatctttgcttgtatcattcttatgttctgcctgcgcgcccgcagctcccagtgaccacccccctgaattcttgaatgacattggaaaaacactcatcgaattaaaaaatgagcatccggaaggcgaattgattgtaaggccggggggattcccagataatgccgctgtatgttttggggaaccggaggcggaatttgcttattactttttcagaacgcagggcggcgatgctgaaaaggtcatgagcgaatgtgaggatcaactgaaatgcgctggttttctcacaaccgcagacatactttttccagacatggaaaatgacatgtcctttgaagatttcttttccctgatcggggtcgatgattatgagtacctgctaggggaagaggtgagaaccggagaaggttggctaattttcatgtatagagatatggaagttatggtgaacacaaacgaaattactcctggcggcggctggaattttacaggagaagacgtcgtgaagcgtaatgctccagtgtctattgcagacccagaaatatcaaataccaatcaggacatagccgatgcggttatgcttgatgaacccatgtcttgaaaacacattattcagatgatgtgtatttatttcttaaatttttgacaggctgcccgctgtgtatattggcagcgggcggcctgtcgatacaaatagtggcgctgttttccatctcgcaaattatcatatggattgtgcgcatatctaacagagcttctttggagatcttatctgcttataaacattatttcagataattacccaggtaaacaaaggttactccggttgccggatatgaatacgtatctacccaagaatttggatttttgccgtctaacgagtttcctgtatgaataacggtagcttttttgttcttggtatctacagaaactacaatgccggtatgcccatattgagagccagaagatccccatttgctatatccaccagccacgctaaaaatccctggtgcttttggagtgctatcaattgcgagaccatagttattcgcaagatttgcgactaaatccttgccgtgtccggatgtagacttcagtgtggtatatgtatcaatataccatcttacaatgtctacacactgaagtccatttacaccatcatagttccccaccttctggaatttggctcgaatctctgatacattagtagctccaccgcttccagaacctccagtacttactttagtaaacttccactgctgttcagtacctccggtagaagctcgccaggaacacttagcgctgttccccgttccgtcagcagtcaaatagcggttagagtactcagacagtctgatggtgtaaacgttggtcttgttcgcaaccttggtaagaattacgtagccgtcaatattgcccgaagctttacgcaaggtgcagttccaattggtgccggaacggtatgcgttcagggcataggcctggttggaaaagtgcttgatatattgtctgctagtggaggtaagggaatcaacaacccaattctggtcattactgccggaggtcgcgtagatgttgacctgcgtgccattggtgatactcgcgctgcttgcaatattgagggagcgggtcggtgcggacagcggactgatcgtgtaagttgccatacttgaaagtctccttttaaagtatattcccgaggtaaatgagcattggatataacttggatataacgacactaactgggaccgggtaatttgcttaggatcagctattaaggcatcgggactcccctcctttagatggatgctttatagagagggaaaaggctccaaagagtaaatctgagccagtgattgtttgaaaaatcccttctccacaaaagagaagggaacaactccaaccatgaagggagaacttattttatagatcctttacttgttcgaacaataaactcaaccgcaatcgcagtagcacaaacctcgccaattagatcacatattcaaataagagttttggcctttattatatgtgtcctcgggcacacctgcgagagcggaatttatatcggtctggcacatgaaagaatcaacaatatttttaaacagctagagaaatcggttgcaaactagcaaatcgtttgtcttataaaatataagcatatctcaagaactcgcttaagatttctcccctgcgaaaatcgagttcggctgaataaaacgatggaaggaggcatgtattccggttgcacaattaggaatacaagaagtgtgaatggatggattgttaagactttggggctgttgctcatcacgtctttgctactcacggggccaggggttgctaaggcatctgaaacaagcaccttttctgacatttcagggcacaagtatgaagcactcatcgagcaagcagcagaagatggctgggtaaacggctgcccagacggaagattttggccagacaggcctataaccaggtgggaatatgcaaaaatgatgttggcggcccttaatattgtcccgggcagtcaacgggcaaaagaggtgctccagtctacggaagtgcccaaagaggtgctgtctttggccgatgacggctgggccagtaaagaaggatgggttgagcttgggttcgcgtcaggactggtagtattgggcgactatggaagttatcttgtgctgccgcatgacgagggcatttcgcgctatgaggcgaccatattcgcagtacggatgctcggccgatttgaagagtccttaacgatggtcgtggaggaaccaccatttgatgatctagtgcccgatatgcaggttgacaattttggagtaattgaaattgccgttgagaatggcttgatttccggatacacggagacgaaattttatcctgcagagtcttttaccagaggagaagcggttgctacagtatcaagagtcctgacccttttagggcgaaattaggagctataagtctgaaaacatacctcttaacactatccccacaggctctcatatctatcaaaaagcggcccaagtttcgacttgggccgcttaaagcaaatcaggtcaggtaaacacaggaagctgtaccatagtagtcttgcttggtattgttgttgccacatacctggccagggtctttaacaccattggtatacccactcgcaacacgcattctgatagccgaagatccgtccatatttacggcgtaatcgcacccaagatcggccatcattttcgcggctaccctcagatccattccgcaccatgtgcaaactagcacaaacgctccgtttgccttatgtcccaacagcgtgcgattagatttgagctctgtgcttccatttgccaatgtgttgttgtgatgatagttcgtattatttaggtcatcccaatcggcaataatacgcttatcatcatctttgtctcgcacagtatactcaaaaaccgacttagagtcatagaccagggcatgaaaggcggaaatgatagtcttacagtacggggccgccaccttgaggcggtcatggttcatccagcggatggtagcagttccgtccgttttgatacaaaaggcaggatattttctccaaggctgataattgatatagttcttcaacttggtatcattgattccactgagcttttcgccggataaataatattttccatcgacatagtgccagccaacaaaggacataccgtccggcccatacgtatcaaagcctgctgcgtttgtctttgcgacaaccttattcgccgcaatcccgggaggattcatctgagctaggggtttcttattacccgtcgtataaattgcctcttcaagagacatcgttttaggatctgtgataaagatacttatcccggaatatgcgctgtctgtagtatacgttacctcactgtagtacttgcttttcaaccctttaaatgttccgtatgccatgagtcgacatccttcctgtttagtatttgtaggcgcctacacatcataaagaatactaatcgaagggattgtaaactaggcattgttcggaaagcaagaaaattattgtcgtaatctgtgccgccgtgcagttctcctcagcccaccaaatttccgttctcgatggtgtaccagtccccgccgctgccagcgatgagtgagaactccgtggatattgggatcgaaagcgagagagatttatccggggactgctggtgtgcttctgccgcacgtcctgacgcctgggatgggaatagtgcgccggcgactgcggcagcttcaaatcgctttgtgcttccagatcttttcatgtgaaaacgccgccatgacagtcgggtagtccggtgaggtttggcatatttacttctgcgtccttttccagtccctatatactataccggtataagaaaagcaacgaaagggtgcacgaaatggaagcagaaatggccttatcatggctcagcgatcttggcaagagtatatttggcaacatggacggcctattttatacgttagttgcctttgtggtgatcgattatatcaccggcgtatgtgttgccatccacaataagcggctgtccagcgatgttggcgcccatgggatcgccaagaagatcgctatttttgcgctggtgtccctgagcagcataatcgaccgtttcctgctgggttccgaggacgtccttcgtaccgtgaccaccgtgttttacattgccaatgaggcaatgagcatattggaaaacgtgggaaaggtagggttgccgctgccacaaaagctgcaaaatttcctgtcccactttgaaaaataccagggcagcagaaaataatttgtcagggcatcctgcgaagtatggagctaatatgaactcctcaagagccagcgtccactgaaagaagaaaccttgcttcaaattctgaaaatttttgttgcataatacaaaaaactatgtctttactaataaggagcacagtgttttcagatatcggatcagcccgagttcgccagactaacacgaataactatggcagcctttttattctttttctttcggaggaaccatgaaaggtggcttcataatgagacttcagttaaaaaagttcattgcggtgacactctgcctaagtgtggtactctcttcctgtaccatccgtccaggaaaccattccaaagaagccctatctcaaaggcctgtttctaccgtggacactaccggttctgaccctcaaacctttgtcattactctgttggaggggcagaccacagctatggtgaacggaacggaagcccagctatctgttgcccccttccttcagaatggctccttctactatccccttgctgatgtggttcgccttatcggcggcggcttctcccaggacggcaataccgccaccattcagcttttcggcacaaccgtaaaatacaccgccgacgatcccgaggtgatcgtcaatggtacttcctatcgcaacaactaccgcctgttgcgatttgcacaggactctgacgaagaatccggtgcaattcccccacagcttttaaacgggactctctttgttccccacgatctctgtcccggaggctgccctaattttgggctcaatgtgacccgagaggccccggaggcccgtatgctaatcctgggtggctataccgatgagcttggaatcgaaggaatccagctctacgacctctttgaccagctgcctgacgagaccagagcgccttttcaatctcagggcgttgctggaactgtgttgaactactacattgaaatgtatttatgcgaaggaaccgaggtatatgtcatgcgctgccccgatgggcaggaagatgtagagggtatgaacggcaaagttgccgcgatccgcctttccggcggaacggcataccgaaccccacggggcctgaccgtgggcgataccgcctaccgcgcctggcttttatatggcaagtgcgcctttaccagctctttttattatcaggtggaagacggctatgtcagcacaatcgtcttccacactcggtactggggaagcagcttctaattcagatcaaaatttaaaaattgtaatttacaaatttaagtataacctctctttatagaatgtacggcgtacaacaaacaacattttataaggagtgaattttatgggaactttgtctttgattacgtccaacggccagtataaaaagtacacctatacccatggcggcgcaagcacaactggcgtacatgtcttcaccacccaatccggccagtccgtggcgcctgccatttccaccaccaaaaagccgttgtctcagctaaatccgctcagcgtctccccctccaatgtgatcgcgaagaccaacggatgcatgtacgagtactacgaaaataagttttatggatttttttatcagggcagcggtaatcccatgtacatcaatggtactaaatataccactctgcctacttcgagcatcatgtacaccgaccccaagtacttcccgtctttctgcatcaagagcgatggaacggcgaccattcggtggttctccagcaaggacgatgccgaaatggcactgcaatattgtgattatgtgatcggcgcctgccatcctctggtctatgatggcaaatgcgtatttaatcaggatgtctatgaaccagaggttctgggcggaaagctcatttataaccgtaataacccttcggacagcaacagcagatataataccggcatcaatcagagcaccgacaagcgaacccttctgggccataaggaaaacgggacatttgtcatggccgttacggatgactctatgtccatgaaaaacgctgccaatctgatgtatgatttggactgcgactacgcggtcaacatggatggcggcagccctgtcgaaatgcggattgcatccggttacggccctgctggcaaagtaagcgaagatggtgggctttctatccatactgccgttgttgcatatcgtacgtaaccttgcagcccctccacatagcaaattctaaagtgagcaccagacccgataaagtcagccgggtctggtgctctatctgtatacacatcaggctgcaagtgtgagagtgtcggcctatgacggacaccccctgcgcgcggcagactgcagctttctcgagaaaatggcaaaaccactttttcgacagtttcaaataattcttcaggctgtcccgatgaagcgaggagtgaaaatggaatcctcaagagctggccttcaaggaaagaaagaaattacgtccagagggatcccacactacttctactccggcggcctcagcaaagaagcggacgggtatgcaaaagactcccccttgaagctctgcgggcacggccagccaattcgtagtttttccgttcaccgtggcccaggtactgtccacggacacctcaatggcgctaccggatttagtgcatacggcggtgccggtaacagcgttataagagaaggtataccccatggcctccgccatagcccgcataggggccatggtgcagcccttcacctggtagggtgcggcaggaaaaggcaccggcaccccatcgatgcttacgctgattccgctctgggccggcctcccgccgcccaggagggtgttcagtgtctggagagaataggtgtgtgcatagtccatctcatagtcaaattttgcatagacaatcacccggataccctgcggcaccggatatgcctggatttctgacgggagaaaacctctctgggtaaaggcatcaaattcggcaagccgcgcctgcaggccagagccatccgtgacccagacgttcccatcacgatcgcattggaacgtatagccgttaagctcgatgcgctccagctggagcggcgaaagggtatccatttcttccatggtgaactggttccaagtaattccgtcatcagagtacaggacaggcttattgctctgaaagctgcacgccaagaactgcgtgccgtcatatcgtcctccgcttgtatagcttggggcggggccagaaaccgaccagtttattccgtctgcggtatagacaaactcgcttttagcatcctgtataacactgtcgctaactctgatatcgccgccgtaggtcgtccgcacacctgttgttatcgtaccgtttgtccccaaaatgcggaggtagacatcttcctttccaggttctgctgcaatagcagacggcagtaggaaggccacagacagcatcgtcaaaagcatacaaacaaatcgtttcatggcgttctccttataaaatcagcattttatttccgcacaaggtttactaacaaaactcatttaactctttgaccatatgtagagaatcagagtaaacatgatttcaaatttgaaaaaaggagcgataatcaatgcctacttctacgtatattgatcgactgaagtatccagagtgtatcatcaaaagcaaaacgaagagcggccctattgataacatcattgaccagtcttattatcctgaagcgaccattggatgctatatgtataagtctgtttatggaagcactcctcataccttttccgatcacattcgtggctttgtagaacctaatgctggtgctcactattatgttcagtctgcaaatagcaccaatttcagcggagcaaagctcacggttaacctgagcaatgtaacggttgacaccaaaaacaatcggaatgcgtatatcgcaatctctatgattgccagtgggactcggttgggcaactgcgacatcggtctctgcaatattggcgacggctggtacccaatgatctgggctccagatcattccactgcttctacgtctgggattgacgcaaaggagaaaaacggcgtttatattaagctcactgacaaaaagacttatttgactggaaccgttaccatcgaggtctctgttgaaaagaaaaatggccgagactatgtaaatgctcgctacctcaagaacagctcggtcgtggcctctgctaccctgtacgaccccgcgggtgattacttcagcaaaaattccacgaagcccctcctgagatgggttcgcttcgtctcccttgtcccgaaggatgacaagacgggcgattggaatgataagtcttttctgaatgtagaccttaccaatctgaaacttgtgcaggcatctaatggagcggatgtaacctggggtaattctaacgcacatgtggagtatgcatggtcgttgcaaggcgcaaatatttcctccctgaagatttccaatgtaactcctggggggactgcaggaaaggatcacgtcgaaattatccaccgctataagctacactaattgaaactctgatcgagtctgagattctaaaatagtatgttactctgattcttttaaaaagccctaacgcttagaaagtatcgatagggtacggcatgcttagggctatgtcgtgcccttaaataaacatttcctacaagtaaagcgcaaatctttattcgtccttatttataaagatgagtttcatgaaaaagtgcaacaggcatttgaaacattttatgccgtgtgccatatcgcaccaaaacataaaagcagcctgtcaaaaaacctccctgcaaagaaaagactctcagagttcctgcggccgcaaccgcaggaataaaatagagggacaagtctcaggatgacgactcatccctctatagttctagattttgaccagcgcggggagaaaatcagagaaagtagtcccccgatacctttattgccgggtgcctgcgggagctctccgacggcacggcggccgcctatgccgccgtgcgggacagccgcctccccgccctcctgaagtccggacagaccgatgtgcacttttcggccaccgtacaccagtcgcccctgctctatcccagcgatatttccactatcttattgctttacaatgtcgataatttccttttgcaataaatgggtatgggaacctttaggcccccatacccattttctcaatcttcagctatttttacaacggatggacatagccacttcaccatctaggccctccaccgtcttcgttggccccactagcgaaaacactgattacttctcctgcaagagttggtatgcggttttgcgggcgcgggtgagagacatgcgcaggctgtctggctttatgttcagctcccgggccatctccgcagcgggcaggttcagtatgtagtacccctccagcagatagcgggtgcgatcatccagctgcggccagatatgggccagcttctccaaatcttcctttttgataatctgaagttctatcgcccctccatccatatcaggatcttcatactccataaactcctgcagatctgatgtggaatgacgcccagaatcccgcaggtaattgcgggactgattcttggaggccgttataatatagttcaccagatggttccgatccttgctgcgaagctcgggaattttgtcaatcagccgaaccagggtcgactgcattacatcttctgcggcccattggttgtgaaccagtttgaagatttcatggtacatcaagcgatgatagtcgacaaagagttgctccatgaaagcgcggtcgtcatcgtcctcaatgactaaaatacaataggggatcattttgcctccttgtggttgtactggcccacaaccgtactgaaatgcagatcccgcaacaggagatggagcgcctttttgcgatccggggacagtgcctgcacgagttggatcatttcaccggaggtcatgtcatccagcagaggcgtagaaaatacgtcgacggggagattggaggaactacggcccaacagataatcagtagtgacagaaaaatagtccgctatttttatcagccgttccgcgtcaggtagatgacggcctttttcataattggaaattgtaccgggggtgacaaaaaagagttttgccagatccctttgggtaagaccacgatcctggcggagctccgccaaaatttctccgaattgcgccatctcgcacctcaaaatttcagattaaatttattatatagtttctgaaatttattccgcaaaatgatagattttcaatattatttgtagtataattcgaaataatatggtttaactatactattatttaatgctgtgctattccaattgggtacacttgaaatcgtccgttgcgcaagcggtttttaggtgtctaccttataggtcgtaatatcgaagaaagggtgtaggggtgtggaacggcgatgcttgcgttgatctcggcagctatagaagatcccgatgaccaggaattcatgacacagttttacctggagtatgagcggttgatgtatgccactgtacggaaacggctcacggatccggaggcggccaaggatattgtccaagaatgtataaccaagctcattcccaaaatctcgtttttaaggcggcaagagcgttgcataaaagccagttatgttgtctctacagttaggaacgccaccatcaactatatgcggaaacaggggcgcacagatggcaggtgctgtagcctggaggaacaggaggagcaggatatggccattccggagccctcgctggatgagcgaattatgcttgcggagcaaaaagaacgcctgatgcagatatggagtagtctgcccgaagaggatcggctgctattggagggaaagtacattttgggctatacggatgccgagctggccgacatgctggggtgcaagaagagcagcgtccgcatgaagctgactagagcccggcggcgggcattccagcttatgacagaggaagaaggtgacaaagtatgaccaggcgtgaagaattgcaggaggcctatgaggacgccatgttcgccctcctgatggactacgtggcggaatctgaaggggaaaaagctctggaggagaaccgtgtacttcaagaggatccagacgcggaggttccccagggggtacgccgggcgtgtctgaaagagatccaccgcgcttttcggaaaaagtctgcccgatctgtggggcggatcacgatgaaggtgatcaacaaggtcgcccttgttgcgctgttgggtacactgcttttctcgactgccttcgctatatccccagagtttcgggttggcaccctcaatatgctaattgatacggtaaatgaaggtgtgagctttcggatttctacacagcctgtttcagaacgggctggcctggaggatctctatcctaaccttataccggatggctatgaactaatagatgaaggcgctttcgcgggtacgtattgggtggattaccaaaacagcccgggcgatcgcttggagattgagctgtctccaagcgggcgatttgatatagaggatacagagctggaaccgactcaaattcacgggcttcctgcgtatatcattgatcaactcaaccttgagggagataaccatggtattattaaggtgattgttctcaatgaggcggagggatatatactcagtgtgatttcgattccgcactcaaccacggctccgccccccatcagccgtgatggcattgtccacatcacagagagtatttttaaataatctctgttgcacatctgttgaagtggtgtcttctgtagtgggtactacccacatcaaagtacaggaggtatacaaacatgggaaagaaatatcttggtaagacaatgcttctgattgcattatctaccactttgcttggggcgagcttaccggcacaggctgcggaaatacttccgaatgaacttgtcatggttcaacctcgtgagattggcattgtaaaaatgaattgccagcttacgatttcttccaacggaaacgcaagctgtttgggtgatgtctctatgaaggcgggctatgactcggaaattacccttgcccttcagaagagcacaaacgagagagcctggtccaatgttgccagttggacgggcagcggcagtgagaaactgacaaaaagccgctttgttacttccggctacgactatcggtgtaagttgactgtcaaggtctataactcctctgggaactatgtgaccacctatacccaatattctgataccatctcttactgattatatacatagagaggcgggcacccaattagggtgcccgcctctctcctttatatgagcattttgggtgttgtgtgccagatgctttggtggtacggagaaataagagacagtcccgcttctgatggtggcttcggctaccggtggaagcgggacatatatttggagtcgtggtttgtgctctactcaaactgtctgaagtgattcctcccttcggcggttttcctgagcttttcccaaagcgacgacggaatggctcggaaaagccgccgaaggagcctccgctatgccctatcaccacccggcaattccaccggtttggggtgattgccggaagttcgccccgcacagaatggcacccgatccgggcgcctcctccatttcgctggttttcattcaaaactagtgaaataggaggaaaagcgtatgccacgacatagtgcatacaatccagactatgaaagcctctattccggtgtagagatcacaccagatgtccttcatgtactcaggacaagtgaccggaaaatgcggtacatggaacatcaactgaagacagggcggtttgtggaagatcaggagcagagggtggcaaaattccttccaagccgggaaacatccctcgatgagatgatagagaaggagcaccggcagttcgcagcagaacagccgtcttgggaggatgaattgctacatcaagaattgatttgtcgtttacattcggcaataaaactgctggaacagtcggaaagagagctgattctggcaatttactttgaaggactgacagagcgtcagctcgcatgtcgggccggcctgcaccacatgaccatacacagccgtaaaatccgcattctgcaaaaactgaaaaacttgctgaaaaagtaaaaaagtttcgtgcaaccccctcactcagtgcctatatagagtgcgggggttcttcaaagctcccggcctgtcctttgaaaacttcatatccggcagcgggatacgtccgctgacgagaggccctccgggaggagggctgaagcgacgctggaggatgcgccaagaccacctgtgcgggatacaattccgcatcaaagacggccaagaaaggtgcagagcggtacccatccgtccacaaagcagcctgtggcgggctgtttcgcattgcggctggttttaaccagcccgaccctcgtcagcaatctgataatgatactcctgtccagccacagccccgggtgataccgggatcaagcaatgggggcagctcggagagatcctcggaggggtgagattcccgtgatgcgcgtcagcgcagtccgtctgctgccgcccagggcccgggaagtagtgtcgaatagggccaaccagcgaaatgcgtttttgaaaaactcagtgggggccgttctgcggccatacgcctcataacggcccccatttcaaaatggagatatgagatgagccagaacatcaattatatcgggatggtgaacctgctccggcatcttcagaccgccggccttgtcagccggaaggaggccgggaggatcgccgcccggctccgggcagaaaccgaggcggacgtcatatttttcccctaatttttgttggggttggatatggatatttcgcggaagtgctggtattgtgtgttgctgataggaggcgattccgtggacgagcagaagaaaaccagcggttccctggcgctgaacggtgcgccccaggtgatcaccattccacccagcgatcctgtccgggatcggaaactccgtgtggcagcctatgcacgggtgagctccggctcggaggatcagcttaactcctttgccgcccagaacgcccactacacggagctcatcaccgacaacccggagtgggagtttgtggacgtgtacgcagacaagggtatcaccggcacctcggcggaaaagcgggacgatttccagcgcctgctggcggactgccggcgtgggcgggtggataagatcctggtgaagtcctcctcccggttcgcccggaacgccaaggagtgcctggaggccgtccgggaactgaaggccctgggggtgggggtatgcttcgaggagcagggcatcgacacctcagagctggccggtgagcttcttaccgccatctttgccatgatggatcagaaggagagcgagaatatctcagacaatatccgctggagcatccaaaaacggatggcacgcggcacattcgtcccctcatcccttccctttggctacaagaaggatgaagacggcggcattatcattgattctggacgggcaaagtatgtacgacagattttctcggattttctgaagggatacaatatgcaggaaattgcaggacacatgaaagagcggcagagcgttgatcctgtgctgagtccctatcaatggaaggttaagtcgattgcccgaattttgaaaaacgaaaaatacgcaggaaattccctttggcaaaagtctttccggacaccaacactgccccgccgctcgttgactaacagaggagagctgaatcaatactatgcgccaaatacacatcctgcaattatcgaccaaactgtatttgacaaagtacaaagcctcctgcgtgagcgggagcaacactattttagcaaggcaaaacgcagcactcccataagtgggatgctgaggtgtggccactgtggagctctctttcggaagcagataaacagcgggattatttactttatctgccgcacccacactgtggatctggctgaatgtcccattggccccattccagagcgcaccatatatgatgccttccttcggctgtaccacaagctccggaaccaaggcatgcccatcctcaagcaattgtccgcagacctccagagcgcccggaagggcaagctgctctggagcctggacatcgtggcactcaaccagaaaattgcagacattacccgtcaggatcgactgttggcccagctcaagcagcaggggcttgtcgatcctgacatttttatatcccgccaaaacgagctggcggaacagctccgcgccgcaaagctggagaaggaacggttcttggaggctgaggaggatcagacgatccagcagacccaggagctgatcgaagctctggaggctgggccagacttcctggacacctttgatggggagttgttccgcgagctcgtggacaagatcatcgtggagagcaatgaccgcctgcggttccggctggtcaacggcctggagctgacagagcccatagaaaggacggtgcggtgatggggagcaaccggaagcggccctttggctaccggatggagctgggcgagaccgtgctccacccggcagaggcggagacggtgcgctggatctacgacagctacctggccggggccagctacaacgctctggtggacaagctccgggagcggggtatcccctatgatggggacaagccctggaacaagaacatggcggcccgtatcctggcggattgccgctacaccggcgagggtggattcccgtccatcatctcagaggcgcagttccacatggtgcaggcacgacggcaggagcggacaacgccctgccaaaagagcccagcccagaaggaactgcggaagctgtgccgcggcagcccaccggactgggtggaacggcaggtactgggccttctgaaccgcctgatccagtacccggagtgcatcacctgccccgtgttggaggatgagccaccgccagaggtgatgaagctgcgccgggaattggacgggctcctgcaccgcccgccggtggatgaggcccaggcaaagaacctggccttccggctggccgccctccagttggacgccatcgggccggaggagtatgaaaccctccgccttcggaggctgttccagggacggacacccatggcagaactggagcaggaactgctccatgagagcgtccgaggcatcaccgtcagcaacgggacggtcaccgtcctgctgaaaaataaccagaccttggaaggaggcaaatgtacatgaacgataccgcgcccaatgtcatcgtcatcccagccaaagtggagacgccccaggaacaggagaagaagcgccacctacgggtggcggcctactgccgggtgtccacggacagcgaggagcagctctccagctatgaaaatcagctctcctactacaccgagaagatcatgaaggaaccgggctggacgatggccggggtattcgcggacgagggcatcaccggcacctccacctgcaagcggaaggagttcctgcggatgatccgccagtgcaggcaggggaagatcgacatgattctggctaaatccgtctcccgcttcgcccgcaacaccgtggacaccctcaacttcacccgggagctgcggagcctgggtatcccagtcatcttcgaggaacagaacatcaactccatctacccggagagcgagttcctgatcaccctgcacggagccttcgcccaggccgagagcgagagcaccagcagccgggtgcgctggggcaagcagcaggctatgcgatccggccatgtcaccataaactacaagaatctgctgggctacgagaaggggccggatggaaaacccgctatcgtcccagagcaggcggagaccgtccgcttcatctatgaccgctacttggctggggacagcgtccgggagatcaaagcggccctggaaggccgggaaatccccacggtctccggaaaaacagagtggatggcatcccatatccggagcatcctgaccaacgagaaatactgcggggacgtcctgctccagaagaccttcatccaggactgcatcagcaagaaggtgatccccaacaccggacagctccccaaatacctgatccaaaaccaccatgagggcatcgtcagccgggagaccttcgacgccgtccagctggagatggcccggcgaaacgccaaggcgggcgccacgcgaaagagcacccccaccggccggggcaagtacagcggcaagcacgtcctcagcaacctactgttctgcggggagtgcgggacggcctaccggcggtgcgtgtggactcagcgcggaatcaagcgccccgtgtggcggtgcgtcagccgcctggactacgggaagaagttctgcacccagtcccccaccctggacgaggaaccgctccagcaggccatcctggccgccgtcaatgccgtcatgctggatcgagacaccctggcccggcagctcaccgccgtcatggagtgggagcttgctccgatgttgggtgagagtatgagcttggcggacattgacggggctctggaagaactgagcagccagttcaacagcctgctggccgaggcgtcagccaacccggcagaggactacacggagcggttccgggagctgtccgagtccaccgcccgtctcaaagaacggaaggcacagctggagggggcctgccaggaacagggccggctccagaaccgcctgcgggcggtgtcggccgccatggaacacatgacggcggcgatgacagagtgggacgaagaggtcgtccaccagctgctggagaaggtgacggtgctctcccgggagaagatccgggtgaccttccgggatggccgggagatcgagcagtatgtggcgcagccaaaaaggaggaagcttgcatgaagatcttcactacaggcgacacccacgggaattttgagcggctccgcccggaatacttcccggagggcctggaactcaccaaggaggatgtggtgctccagctgggagacttcggcggcgtgtggttcggagatgaacgggacgacgaggcgctggactggctggaagggctgaccttcacggtggccttcgtctcgggaaaccatgaaaactacgatgcccttgtgaaatacccgatagagaactggcacggcggcagggtgcagcccgtcaggccccacgtgctccacctgatgcgggggcaagtatttgagctggccgggcataccttcttcactatgggcggggcggcctcccacgacattgaggacggcatcctgagcctggacgatcccggctttgagcggaaatacctgacattgaagcagaaagagcacacccgattccgcatcgaacacctatcctggtggagggaagagttaccctcagaggaggaatatgcagaagcacgtaaaaacctggacgcctacggctgggcggtggactacatcctcacccactgcgcccccaccggcatcgccctccagctctcctggcacaatgtggcggatcacctgacggacttcctccaggaggtcaaagaccgggcccaataccactactggctgtttggccactaccatgacaacagagccattgataccaagcacatcctcctgtgggagcaaatcgtgcagatcctataagcagaaggccataagggaaagggcggcggttccgccgccttttcctttgcggctttccgcttgagacaatacgtcggaaaggacaagaagatgaacaagcgaaagctggttgactatacctcaatgtacgaagccttggccaccctcatgaaaaccgagctgccggaggtggaattgtactttgcgattggatgggctgtctgcgcccgcccggagaagggcgcggcggtgatggccgctgagcatctccaggcaagctgccctgaaagcaagggcttctccccacgaaacctgcgacggatgcgggagttctaccgagcctacgcagatagccgggagctgcaggcgctggccctaaagctgggctggacgcagaacgtggccattctggagggctgtgaaggcagccaggaacgcgcctggtatctccgggctgcgctggaacaccgctggactaagacggagctgatggagcagatccaggccggggcatggctgcaggaaggactcgacgagctgggcaatacctgctatactgagagcaacacagtatcagcggggtgtctggagcatgaaaaagatcctttttatgtgtcacggcaatatttgtcggagcccgatggccgagtatgtgatgaaggacttggtgaaaaagtcaggtctggaggaggagtttcagatcgcctcggcggccaccagccgggaggagatcggcaacccagtctaccctccagcccggcggaagctggcggagcacggcatctcctgcggcggtcacgccgcccgacagctccgcaaccgcgactacgaggaatacgacctgctcattgggatggacagggccaacctccgcagcatgtaccgcatctgcggcggcgacttcaacgacaagatgcacctcctgatggaatatgtcggccgcccggagcaggaggtggccgatccctggtacaccgacgacttcgacgccacctggcgggatgtgctggcggggtgtcaggggctgctggatcaaatcattatacaagaagggtgagcccatggcgtcaaagaagcctatgaaagatcacatccacgccaaaggggcagatattgccgtcgtttccagcggcgatgagaacgactacatctctctgacagatattgcacgctataagaacgatgccccggatgatgtgatcaagaattggatgcggaaccgggacacaattgaattcctggggttatgggagcagctcaacaatccggaattcaaacccgtcgaattcgacgggtttaggatccaggccggttctaacgcatttaccatgtctccgaagaagtaggttgacacgaccggagcaatcgggattttctccaaggctgggagatatggcggtacatttgcgcacagggatattgctttcgagtttgcctcctggatttccgctgagttcaagctatacatcatcaaggactaccagcggctaaaggcggatgaaaacagccggcttgcccttggctggaatctcaaccggacactggcaaaaatcaattaccgtatccataccgatgctatcaaagacatgctgatccctccggacatcactccacagcggcagagctttacctatgccagcgaggctgatgtcctgaatgtagcactgttcggcatcacagcaaaagaatggaggcaggcacaccctgacagcccaggtaacatccgcgatgaggcaagccttcagcagttgattgttctggcaaacctagagagcatcaatgcagagctgatccggcagggcgtttcccaaagcgaacgcctgctacggcttaacgccagcgccaaacaaatgatgaagtccttagtgggagaccacaaaattgagctgctggatgagaagaccaacaaataaatagataagaaagcgaaaatgagatgcaggtattgatacccccatatcgaccgagcaggtagagcgatttacgaggtataacggatggacaaagagataataaagcgttttagagatgaagtgaacgcacaagatttagtcttgcaaatgtatcgtaattatgcagggaaaaattattggaatattatatgttcggctatggattggatcgatgttgttgtagaaatgatcgacataaaaaacgtttccaagaaaaacgataatgattccagcataaaagttatgacctttattatgtgtattgatgtgatgtgggaggctgtccaacagttacataggatattttttgataccagcacgattccctttgctgataacacggaagtgttttgccataaactgtttcaagcctcagataacgactatttcaagactatacgagcctgttttgccgcacatccgatcaatttgaatgaccactttactggaaataagcaaaaagaacgtcgctatgcgagttggtctggtggagggttcagcagtggtgacttttctgtaatgctatatagtaaccaaccggataaagatgcgcttttccttgatatatattttgatgaattactaaagtttgctgagcaacgctatgcttatcttaatacaatctccacgaaaattgtctggcagagggagcaatatctaaattcttggaaaagtataaaaatagagcggacaggttcccttgatgagcagatattagttttaattaaagaagcaaaacaacggtttgataacgactattataattatgaattggatcaacttaaaataatattttctactcaaattacgaatcccacaaatttaagaattgtaaatcaatataggacggcacttttgtgtaaagtggacgaattgtttgcagtgctccaggagatgagactcataactctcgagagcacggaaaaaattaacgatcattgtcctaccgaatatcagtatacattttccaaattagttgatgccgtgttttgcagtggttcgatacaactagtcaatataaacgattttaaagtatgcttgggccatcttattgattttggaaatattgaatctatcgaagaactttatgtatgtgtaaaagccgggttcttctatttaaattccaaaggatatccttgaaatcttatatattggaacctttgcatacttgcagtgagccaaatattttcgctccaaaattgtgtttccagtaaaactctcatacggcggacttcggccaccacttaggggaaatatagtcaccactgaaaaatatccagattgaagcccaggttcatatggacaagggtaggagtattgaacagttttcttagactgtccaatactcctacccttattccatgggagaaagccttggtatttcaggtgttttcttttctcttgcacagctcggtaattcatatcgcaaagataaaagacgcaagcttggtggttgaaaaatgaaaaatacccagttttgaaccctttgtccagatcagcctgtccgttctttcctttgcgcatggagcaattcaaacctatccggcgtcctgtagttgagcgtgctgtgggggcgcttggtgttgtaaaattctatgtaagtatcaacgctttgcatgaactggcgctcagagcaatattgtgtccgataaatctcctcccgcttcatggaggcaaagaaggactcggctacagcattgtcatgaggacggctggacttcgagaaagattggacaaccttgtttatgcgaagtagtttccggaatgtgttggatgtatattgcgggccttggtcgctgtgaaacatcagctgctggggctcgtttctgttccgatatacctgacgaaaggtagaggtaaccaagtaggtactattctttggtgatactctgtgggctactactttacgtgagaaaaggtcgaggattacgcagatatagagatacttgccattgaccttaaagcaagtgatgtcgctgacccaaacacggttcggttcatccactttgaattgctgctgtagcatgttctgcttttttgccagccgctcacttttctgataatcgcgtttggagtagatggatacactttgtaatcccatttctctcatcagttcagccacatacttgggcgaagtccgaacgcctcgatctgctaacacagcagcgattttatttgcgccaaacctttgttggctctcatcgaaagctgcttggatatgctctttcatctcggctcttcgtttatcataggctgttacctcttttcgccggaagatatggttgtagaaggtaccgcgggatacacaaagcgcctcgcataaggcatggacactatactgaccatgcaatttggcaagctcttgcagcttttcttgaagcgacgctgaaaccgtgcagttgaccttttgtaaaatctcgatcttcttctccaacttttgaagtttctgtttcattttgataaacgcctgctggctgacagcatgaccggagtctgtcatggtcacagtgtacggcttgatccatgtgtagaacgtactcttgggcacgccggagtcggcgcagatatcggagacggattctccggcctggtaacgagcaaccagggagtgcttttcttctatgctgatgcgcatgatttgattcctcctgtaaaatggtgtagaataccattgtacagaaaccagtattcatttccaaagatgcaatttttccaaagtaagatactgtaaaatgcattaagcatcaaggattagtccattccgaaaacccgattagaaaacttagtttatttaatactggtgaggagaaaggcatatgtacatacagaagatacacattgaaaattttagactattaaagaatgtagatatcgttttagacaaatctttaacgctgatagttggtaaaaataatactggtaagacatcagttgcccatctgcttcaatcaatcattaacgaaaagaagaatttatcgtttaacgactatcctcttgaatgtcggaaacagctttatgaggcacttgaaaaatactgggcaggtcaacttaaaaatactgagataaaaaatcaaatagaggaaacgaaggtatgagattctcggaacaacgcgtcagccaatagagactaagaggcagaagaagcagtggcgagagcttacaggtgatttatgtgtcgcaagacaaggaactatctatgacattttaaggacagctgctgatagtaggttgattcctattcctccagatattgaaaattatatggaagaatataattctggtgatgattctgcctatgagcagacgaccctaaaacagttttatgaaattaaatatggtgaagtcatcaatgctattaatttcttcaagccggatgccgtgtactccacagaccatggagtaaaaggtgaggagtacgaaaatgttctttttgtgatgggcagaggatggaatctctgcaagtttgaagattcattatataaagacgaaaaatccctgcaaggcaaagaacttgcaacatacattaggaattgaaacttgttttacgtgtgttgttccaggccgaggaagagactcgctattttagttactgtagagattaacgcacaattcgaaacgtatttgcgcaatgtatttggtgctgataatgtggtaccatatagtgagtttataatgtgaaactccaatatgcataggtgcttttatctttttagtatattagtgtagcctttcctcaaaacaaaaacgttgcggctactttccaaccgcgacccatttacactgggagcgcggtcggtgtaccacactataggggcttttccctgaaacgggaaaatatcgattttaaccgtcccttccaaaaaatagccacaccgaaaggtgtggctattttttggttaccgggaagattttacatgctcgggcggagtgaatccgccctgcgccaaggttttcgcttgcggcgaaaacgcttgtacggcgcaaaggcgccgccggccagaaggccggagcttccgggttgtaaatatccagattgatctggcacttcataagaaaccctggaacttcaatggttccagggtttttctttttgccttaaattgcaaaattttagttcattgccgtcccggcggcgtcctaaatttaatattttgcatttctgccaatcatattttcgatgctatagcatgtcaaaaattcatactggatgtctgccacctgtgcaataaggagccaggcatatcaaaaagggggatgtaattttacattccccctttattatgtggaagaagtttaaacatgaatattttagcagtttatgtcctaatatatacaaagaagagttttcttgtcgcaaattatagctcagtgagattaaggaaccaatctatataacttgatatattccgctgtaaaaagagaaataaaaattctaaatatttttgctgttctcagctttctattttgttatttcatatagagacatttattaaatagaaactctaaatctcattaagtgaggaatatttctggatatttttatacactgggccgaaaaataacttatccgtacgacaacgggccgcggttcggctcgtttatgacgaaccgatggagaaactgaccgagaaacagaacctaaccaccggccccatggacccggcggactgttatgtgccgggattcgggtagaaaatagataccgtgtgcttcccaatggcatgggctatgcggaaatcctgatcaggcagattacggatgagatgattcacaagtaccgggagaagtttacacatgacgggctgggagcctgtctaaaagctctggctcgccggggctggctggctgcggagcccgtctatacctgcatagtacaacacaccagagagacccaggagggccgggaactgtgggggcggtattggagcggcatctccgttggttcgagtaccacctagtacagtctaaacacattgatagacccggattagagtacacataaagctgataatggagcactgcatgaggaagtaccggaacagactgaggcggatgaagcagttctggagcatccggtatttcataagaattccggggggagcctgggaagtgaaaaaagacctgctgcattcatgcagcaggtcttcttgagtgcgcagtcaaaatcaatacacgccgtacttgtaaacgcgatcgggaacgtccttattgatcttgtcctcgtcgatcatggccacggcgcggacgatggtgccgtcgcccatataccagcgcagcgggaaggcacagaacatgaagcgctgtcccttcaccttctcgatgtcgccgcccaggttctcaatacccatgacgttgttgcccagcaggatggtatgcaccggctcccactcggggtagtcctcgatgggctcatgaccaaactccttcttgtactcgtccacgatgcgggggacgtaggggccggggccgtgctgggccgcgtaggtatagaggatgtggtccagggcctgcagatcgaagcccacgcccttgaccttgtggtccaccagccagtgggcgccctcgatggacatgccgggggagtacatgaagtagtcgtcgttctcgccccagcgctggttcatgccggtgcagatgagaacccagtcgccctcctggatgccgccctccaccttggcggcggccttctcgatgtcctcaacggtgatcagctcccagtgctttttggggatatccaggcagaccgcagggccatagtagttctccagaggcagctcgtgggtataaggagactcgggaatcacgtgggagggggagtcggcgtgggtggagttgtgcatgtggaagtcgttgaaggtctgaagcagacgatagtgcatgggcatgtgctgcacacggtcgatgtggaagtcgccgttggagggccacaggggattgccgcggccgaagggatgggacaggtcgacaagtacggtcttgcccatagtataagactccttttctttatgattaaaattgagttgtaacaaaatcaggaacagacggcgggctgaaaatgaagatctgtggcggtctggatcatctcatcccaggtggaaaagcgggtgctctcctgcacgaaacggtccaaaagcgcgtcgtcatagatgagacagtcggaattccagtttacaaagacagcgctggagtagcgaaagccctcaaaggactggaaacgggtattggcctgcatgaaggaatcgtcaaagatttgcatcagcaggtccttcattttctgggggtagtccacatattgaaaagccatatcaaccttcctgactgccgtagaacttctgggcctgttcctctacgtacttacgccacacgggctggtcggcagccatacggggacggatgtactcgctcatctggccgcccttgccgtggaccagctcgccgttgctgatggacatatacagcagaggctcagagggggggcagccctcgatgtggatggcgttggggtgcttcttcaggtatttgcgggtacagttgccgtggagcaccagcttctcgtcgggtacctcgtcgggcacttcattttttccgccggccacaaccacgaagtcggagcggcgctcgtagtcgccgatggccttcagagtctccatgttgatggccagcaacgcctgacagctggagcaggcgccatcacacagcaccttgtactcgggccaacgggtgctcatatcaccgatgtagggaacccacattttcttatagcattcggcgacggtggcgcccacaacgtcaatgttctcccgctcggtgatacccagtccggtctcggcagccacccggaagtaatccaccgcctcggcgtcgatgccgaccagatcgcaggcgatcaggtccacggccacgggatcggaggaccccaggatgcagcccacttcaatgggaacgggggtgtggggggagtagccgctggcgggacggatggcgtccacgatgttgatatccgcgcggcacacgctccacacatccatcatagccatggtcagattctgctggtgcatctgcaggtgtacagcatcctgcaccacacccttaatattcttcagggcgcaggagaacaccatgctggcgtgcgccttcaggatgggcaggttgatgagatgatcggcctccagcaggcggcggggcagcttgacatgatggaggttggagcggtagccgcggacagccacattgatcaggtccttgtcggccttaatatcgtagagctccacgccctcctcgcgggccacatcggctatgccagagacctcatagcattccatggtatcgcagccgatggcggcagcctcggcaataacaatgctcttgggattggctttcttgacttcgcggatgactgcgcggacgacctcgggattggtgcagaccgaagtatcggcgggggaagcgtggccggcgttgggcttgagcattacagtggtgccgggcttgatcatgtttgttacgccgcccatcaggtcaaagaccttggtgacgctgtcctgaatactggcctctttggccagagcaaccagcgctttcttgtcagacatactcagttctcccttcagttcttggtaatctctatttccatcaatggattatgcaaggctgatgccaagtgtaatgagccgctttttgctaaattgcagggggatttggggcgtgttgttgcagaaataggacaatacacaattgcttgttgcagcgctgaaacaaacttagagtagcttatgaagcttgagcagctcggcgaaggcgtaatcccggaatttgcacacactgtcgaccgtgttgccaatggagggatcccggttggcgatctcctcgtcaaccccttgggcgtatacctcattccagggggttgactcctcgccgtatttatcggcaatggcccggaagccgccttccacgcccagactgatagtgagcagctggccggtgaccgccatacgcatgccggggccgaacataattgccttgtccatgtcctccacagagcatacgccgtcccgcacgcactccttggcggcatctagtgcggcccaggaaaggcggttgacaataaagccgtagatctcttttttacacaccacggccaccttacccatgccagtgtaaatctccttggccttttcaatggcttcgggggcggtctgctcaccgccgcacagctcgatcagaggcagcaggtaggcggggttataggggtggcccaccaagatagattggggatagagggagccctcctgaagcttggtggggaagagcttggaggtggagctgcatataatggcgtcgggacccgtgactttctgaatggtggcataggtggattttttcaattccagccgctcggggatgcattcctgcacgaaattagcgcccttcacggcatcctccagatcattcgagaaatgacaggcatttagtgcggcatcggcctgctctctggtggcggcgccagccccaactaggatatccaggatatggctgatattctggcgcattttctcatgaggcaccacatcgtagagaaccgtctgataaccgttcagcatggcgttggcagccaagccggcgccgatcataccggtgcctacaaaaactgctttgatattgcccatgtcactttcctcatttctttgtttgttatccagggcgtctatggttactgcgtccttacgaaaagaataaagcaaacgacgtgccaaatatttgagcattaaacaaggctacaaacggcttattttaatctggcgttgcaaaatggaatcaaattgggacagtgaatggcgctgttattgcaaatatgcaacagcagcgccggtgagaaaacaagtagtaaaaaacagaaagatatagaagtttctgtttgctcctaaaataggttttatgtggaatcctgtccctgtctgtgatttttctggaggagcgttgacaaacgagttgtaatgctgttaaattagtgaaacacaaggagggcctatgtaaggctttcattttaaggttgattcgcacaagtgtgtttattgtgcccggtgcatccagccctgcgcttcagtgatcctgtattttgatgaatcgggattgccggccataaagcagaaggccgacggcgttgtgtgtgggggatggctgctgcggctgtcagcactgcatggcagagcaggcggctctaccctggcagcatcagcaaaagcgactgggaaaagcagttggagtgagagccgggcccgcaatcccggcgtcatgttttttgtcactgcgccccatatccttatgatccactcataacgggagtgaggacagtggaggactggtccggtattacagcctgattctgggttttggctatctggaatatcgctatgcctgtggcgtacagcgggaggggaccgcggaaatcagggagctgaacctctggacgcctttgtaccgatggaaaagatggataaaggagaaacgtaatgaaccagtattcggccatacgagaggtgcggaggcttctcagagcagtaatggagcaaagccagcgaccggaactgattgaacagttggaggagattgacgtccgattaaaggcgtttcatgaccggggcattgattttaaagaagtggtggacgggctggatgacagcatcatgattaccgatgcggaggggacggtgttgtacatcaaccctgcctacacccgcaacacagagattacagaggaggacgtgcttaatcgggatgtccgtagcctgattggcaaggacaaactgtttaccggcggcgcggtgaccagtgtgctggagagtgggaagagcgcctttcggctctccaccacttacaagaccggggagccgttggtgggctatgtggtggggacgcccatcttcaaggaggacggcagcctacgccaggtagtggcttgcagccggcccatcgtgacgctcagctcgttgcaggaggattttgaggcatttgttaaggaaatcaatgccatccaccccaagaccatcaccacggactcagacaagcatctgtcggagggaatgatagggaaatacggctccttgaagcagatcgacactctgctggaccgggtggcgcccaccgatgcctcggtcctcatcaccggcgaatccggcgtgggcaaggaggtggtagcggacgagatctaccgccgcagcctgcggaagaacaagccctatgtaaagattaactgtgcctcaatcccgggacatctgctggagtcggagctctttggatatgagaagggggccttcaccggagccaacaccaagggcaaggtcggcctgtttgagtacgctaaccacggtacacttatgctggacgagattggcgatatgcccatggacctacaggtaaaactgttgcgggccatccagtcccaggagatcacccgcatcggcggaacccgccccatcaagctggatatccgctttctggcactgaccaacgcagacctaaagaagaaggtggcggaggggagtttccgccaggacctctactaccggctcaatgtgatccccattgctgtgccggcgctgcggcagcgcacagaggattttgaggagctgtgccggcactttattcatcgctttaccaaaaaatatgaccggaccttttgcctgacggaatggcagatcgactatatgaaacgctatcagtggccgggcaacatccgggaactggagaacgtgatggagtacctgatcctgtgcagttccggtatcggccgcattgaggacgatgtgctgagaggtctgctgaacgtgccggaggagaacctggggccacagccggcagcgcccgcaattgtggagtgtgcacaggaagaggagccggaggagctgccgccggaggacctggacttcaacaccgcagtggctggatttgagaaaaagctgctggagcaggtgctgaaggaatcgtccaatctacgggaggccagccgcaagctgaatattaacgcctctaccatctgccgcaagatcaagcagtatgggattgactacgaaaaccgcagaagctgattcaaatagaaagcagcaagggccgcccgattattccggcggcccttgctgcttagagagagattgaaataggcggggaacggattacttcatcagctcctgctcggtagccacgtccttgttgtacctggtgggatggatgatggcggtaaggatcatgttgaccacaagcaggccgatgtagaagatgtaggcgccccgcaggctgccggtgacccggatggcgaaggcgttaacctggtagttggtcatgagcacaatctgcatcagggggaagaacacagagttgaccatggtgaagccatggcggccgaacacagaggcggacagggacacgatgaagttggcggcggcgcccacggcaatgccgatcatagctacagacacatacacaccgattgtggtgtcagtacagttgatggccaaggcgatgcagtaccagatcaggaagaggataatggcctttttgacgccgaacttctggtcaatggcgccgaagaggtaggaaccgcacacgccgatgatggcgcacaccgtcatcaggcccacagcggcctcctgagagaagcccaagctggtattgcggaccaccagctggctcatgacgccggtggtcaccagctggttgatgccgatgatgagggcgcacagccacagctccttggttttcagcagcttaccggcagtccagccgccgttgtcctcactgttgccctggaagtactcccgctcatagacctcgcgggtcacgttgtcaggatacatgccgcactcctggggggtgttgcggacaagaaccaggccgatgatgcccagcacgatggcccccaccgccacgtagctcatgccgttggcaaagccgaaagcgccgatggtgaaggaaatcagaggcacatagaaggcggagccgcagttatggcccatggtggtgaagccgttggccagacccttcttcttggggaaccactgggcaatcagggtgttgccggcgatgtaggcggcgccgttgataaagcaggttaccagggtcagggcaatgaagtaggtggtcagggtggtgctgtgccccagaaaaatgtaggacaggccggcgccgatcaggcagacgccggacagcagccgggggcccacggatacgttgatgcgggcgatgagaatataggctacaacaccgatcatgccggcccaggtagccacgcccagcacctggtcgtaggcgatgccggtggactcggcgaaggcgggagctacgatgttcaggccgtcaatggaaaagccgatcagaaagaagaacatcagggcctggtacaggatgatgccccagcctttggagaacttcatgctcatattttcactggcgatttgggaactctttttactcataggttactcactcctcttttgtactgtagatggtcagccttggctctgttgtaccggcttgcgccggcggcaagacttgcctcctctctctccatttcgttcaacaaataggttaagagcaaagttgatgccaataaaataggataaaattacatgatagaaaggccctgggcaaaaggatagctacgcatccgttgcacggcggcaacaggcatttttgctttgcaacagctatccccgggccaactgtaggaggctgactaccgcgccgtagtccaaggcccggaagttgccgcccagcgttcctgccatatcgggcaaagccagccgcgccaggtgctcaatggaaacgtcgcacaaaccagcctcccgaagtgtaaccggaaggcctgacgagcagaggaagtcctgaaacgcggagatgccgttttgggcggtttgaatctggctgggacaagaggggacctgccaaaccagggtgcaaaagtcggcaatggcctcggtttcatcggtgagcatatacttgcaccatgcggtcatcaggatacccagggccgcaccgtggggcaggcccagctcggtggtaaacacatgagagagggcgtgacaggcaaagtccccctcaaaccccagcatattactgtgggccacggtggaggcccacatcagttggctgcgggcatcatagctgtcggggtgagccagcgcccggggcagctctgtaatcacagtgcgcatcaccgccgcacacatctggctgcggagggtgccctgctgccccttgtggaaataccgctcaaaagcgtgagaaaagatatctaccgcgcaggaggcggtctgtcggggcggtagtgtataggtgaggactggattcatcagtgcgaagcgggggcgggtcagaggctcgtccagggccgccttttcgtggaggacatcgtggcagaggacagagaccccgttggcctcactggcggtagcggcggtggtgagcaccacgccgatgggcagggcccgctgagtttgggctttgccgctgtatagttcccatagggggacgctgtttttggcacccaggcttatggccttcgcggtgtcgatcacactgccgccgcccacggccagcagcagggtgatctttttttccgtggccagccgccggccttcctccgcagtggaaaggaccgggttttcctggataccgccaaagagggtgaccgtaaggccgtgagcctccaaatcggcggtgagtctgcccagcaggccgctgcggcggatgcgatcgctgccgtaaagcaacatgacgttgggaccaaagggggcagagagtgccccggcatgggtttccgcatcccggccgaagattacctgtgtgggaaaggaaaaggtaaagtttttcatggaagtatcacagtcaggccatcttgataagcacggcggtacccatgccgcctccggcgcacagggtggccaggccgtatttgccgccccggcgtttcaactcgtagagcagggtgaccaccagacggctgccggtggcgcccacagggtggcccagagaaatgccgccgccgttgacgttcagcttgtcctcgtcgatgcccagggtgcgctggcaggccacacactgggcagcaaaggcttcgttgatctcgaagaggtcgatatcagacacggtgaggccagccttctccagcaccttctgggtggcgctgatggggccgatgcccatcaggtcgggggaaacgccggtggtggccacagcgactacgcgggccaggatgggcagtcccagctttttggaaagctcctcctccattagcagaacgccggaggaggcgtcgttcatgccggaggcgttgccggcggtgacccggccgtcggccttaaaggtgggcttcagcttagccagcttctccagggtggtgtcccggcggacgtgctcgtcggtagtaatgacggtgttctccctcttgccatggacggtgatggggatgatctcctcctcgaatttgcctgcgtcaatggcggcggcggcacgctgctgggagcggagggcatactgatccatgtcctcccgggtaaccccgtaggcatcggccacgttttcggcagtgatgcccatagaggggcccacgcccaggttggtcagggagtcccacatggaatcccgcagctccatgtggccgtacttcttgccgtagcgggcgtcaaacaccataaagggagcggcgctcatgcagtcggcaccgccggccataatgcacttggcctccccggccatgatctgatagaagcccaactgaatggaggacatggaggaggtgcagttgcggtggacggtgattccgggcaccgtgtcggggaggccggccttgatggcggccacgcgggccaggttgttctccaaataggtgcgctggtagttgcagccccagatcacatcgtcgatgagggcggggtccacgccggagcgctggatcagagcctgcatcaccgggatggacaggtccagggcggtcaaggtcttgaactgaccgccgatggtgccgatgggggtgcggcaggcggatacgattgcaacatgattcatacagaataactcctctcaaggtgtggtgggattggttctttgaatataaactgcaagtcagatgccaacaattttgcttgatttttaggaataaacctcccacctaacactgcgatgatgcggggatgcaacaagaagggggtacaagcaggtgtgcttgttccaaaaatgcaatagcggaggagagcaaagctgtaaaacccggctgcgggacggaaaacagacgggtgggcatggaggaaaatgtgatgtataccaggagtgtaccggctaagagcaacgtccggtttgtggagcgggcaaagcgggtcatcgaggagtacggcaagcaggccgccacccctgacgaagcccgggagctcttaaacctgaacatacaggtgtatttatttaggaagaatggtggtgtccatcggtggacaccaccattcttcggtccaacctaaacagcgcgcgcatgacctgcggcttggcccagaggccggaataccgggatctgatgactgccgcctccaagctgaccggcgagcgggtaaaccgctccacccacaaccacagcgtaagggggcggggggccgtgtgtgccggcgtgaactactgcggcaaccccggatgtgacttggtgttggtggtgcgcggctaccagataaggtgtgcggatatcggatgggtaacagggcggaacgtcctctatttctggcttgcggaggagctcatgtagctgcgataggacacaagtccgcatcaaagacggccaagaaagatgcagagcggtacccatccgtccacaaagcagcctgtggcgggctggtgcgcattgcggctggttattgacaaggcgctatttgaccaggttcaaacgcgcctgtgcaagcggaagcagtgctatttcagcaaggtgaattgcggggctctcttttgaaagcaggcgaacagcaggattccctgcctttgctgtcacccccataatgtatttgtcagacatttagagcaaaccaatgcttttttaaatagtgattatggtttcatgcatttcgcacaatttaaaagtatgatataataatatacctagataatgcggtgattagcggaaagggtaggtggccatgcaatcaggaaaaggcgttgttcatctgacagaactggaaagcggggactataaaagtatctgtgaaaacctttacgacgggatacacatcaccgacggtacgggtaccattctgtttattaacaaggcctatacccgtacaactggaatcctcccggaggagctgttggggcggaaggtatcggaaattgaggcggagggaattctttacaccggctctgtaacggaacgcgtgctggctcaaggcaagagaatcaactctgtggccacgattcatcgtttgaataaagaagtactggtgacagggacgccggtgtttgacgaggagaagaatatcaggctggtagtaaccaacacacgggacttcccagagctgaagcggctggaggctcaactattggctttggagaaaaagcaggaaaaagcagttcaggaactggcctatctccgcagccggcaggcgggcgataagcagacgatctaccacagcgcggccatgcgggaagtgatggagattgtgcggaaagttgcgccgacggatgtcacggtacttatcacgggggaatctggtacgggtaaggaactcatcgccaacgagatttatcagaacagcgaccggtgcggcaaaccctttatcaaactcaactgtgccgctatccctgctgaactgttggagtctgaactattcggatatgaggagggggcctttacgggggccaaacgaaccggaaaagcaggcatgttcgagttggccaataccggagttcttcttttggatgaggttggggatatgcccatggcactccaggccaagctgctccgggtacttcaggagcgcagcctggtgcgtctgggtggcagcaagacgatagatttggatatccgggtgattgcagccaccaataaggaattgctgacacaggtgcggcaggggaggttccgggaggatttgtactatcggctcagtgtggtgcctatcgaactcaagcccctacgggagcgtcgggaggacattccggtactggccaggcacttttgtgagctgtatcggcgtaaatacggaaaagagaccgaactctccccaaacgccgtggcagagttagccaagtatgactggcctggcaacatcagagagctggaaaatctggtggagcggctggtggttaccgacagtgtgggtgaaattggtggctgccaggttgcgtcggcgctgaatttttccggtaccgcggtaccggaggctggccctttgagggccagcctccggtaccgcggtaccggaggctggccctttgagggccagcctcaaaactcaactacagacctttgaacgtgaattgatcctcggagctctggagcggactggttcccttcgcaaggcggcggccagcctgggggtagagcattctactcttgtaaaaaaatgtaagagactggggattagctccgcaaaacggtgatttttttgaccactatggtgaattttttccgactcaaggaatataacatttttaaatttctataatcagcataacttgcccaagttttctggtctacatgtggataaagtacaagggttgtatagggaggagagagaagggcctggtgattattttcaccaggcccttctctctcctccttctcctgtaccgctataattccttgcggctcagtagattccgggaaatctataaggaatatataaaattggcacgaaaattgcggaagtaaattagtaaatttgtaggaggaggcaaaaccatgagcgagctgaagaacaagacgatcatcactgtggccactacgggcgcctggcccaccaaggccaacaaccccaacgtgcccatgaccccggaggagatttccgaggacgtgtacgcctgctggaaggccggcgcggccatcgcccacctgcacatgcgggacgacgaggggcacggcaccatggacaaggagaagttccgcaagaccgtggagctgctgcgcgccaaccaccccgactgcgacatcatcctgaacatgaccacctccggcgacatccacgccgacgacaccacccgccagatccacctgaaggagctgcgccccgagatgggttcctatgactgcggctccatgaactggctgcacacctccctgttcctcaaccctcctgccttcctggaggagttgggcaagaacatgcaggagtggggcgtgaagccggagattgaggcctttgacccgggcatgattgccaacgccgcctactacctgaagaagggcgtgctgaaggccccccttcacttccagttctgcatgggctgcgccaacggcatccccggctccctgaagaacctgatctttatgaaggaaaccatggagtccctgtgccccggctccacctggagctgctttggtgtgggccactgcgcgttggagatgctgtacggcgctgtggcgctgggcggccacatccgcgtgggcatggaggacaacgtgatgtacgccaagggcgttctggccgagagcaacgtgcagttcgtggagcgcgcccgccgcgtcatcgaggagtacggcaagcaggtcgccacccccgccgaggcccgcgggattttgggcttgaagtgaaaaaaggaagtcgagcagcatgaaagaaatcaagaacattctcatctgtggcgcgggcatgatgggcaagaacatcggttatgtgtttgcgtccaaccccagcttccaggtgggtatgtatgatctgtaccccactgatgtggaggcgggcatccgcaccaacaccaggcagctcctggacaagggcgtcatcaccgagcaggagctgagcgaccgtctctcccgcatctcctttaccaacgacatcgacagcgatctggtgaagaacgccgatctggtgatcgaagccgttttcgaggacatgaagatcaagcgggagaccttcgccaagctggaggcgcgctgccgccccgacaccatcttctgcaccaactcctctgtcatgagccccagcgagatctccgccgagctgaagcaccgtgagcgctttgtaggcactcacttctggaaccccggccacctgatccccctggtggaggtggtcaagtccgacgcctccagcgacgaggtggcccagacggtgatggaggtgctccgctccgtgggcaagaagcccgtgctgtgcaaaaaggacgtgcccggcttcatcgccaaccgcatgcagcacgccctgtggcgtgaggccatctccatcgtggagaacggcatcgccgacgccgccaccgtggacgaggcggtgcgctactccttcggcctgcggctgccccagctcggccccatggagaacgccgacatggtgggtaccgacctgacctataacatccacgactacatcctgcgggatctggaggactcccacgagccttcccccctgctcaagcagctccgcgatgcgggcaagatcggcttcaagaccggcgagggcttccagaagtggacgcctgagcaggtcgcccagtccaacgccgagctcaatgagtatctgattcggatgctctacggaaagtaaggaaagtgtgttccgcgactcacatgccatagatagaacgagagaatgagaaaggaagcgatcccatgtcgaaacagccccaagcagcagcccaactgaagggcactccgctgtggcgtatgagcaaaaagttcaatttcgccgcagagaaaattattccggactcttttgtgttctgtatcatcttgaccttccttgtgttcgtgctgtcccttctcctgtgcggcaaaagcccgctggagcttctggtgggatggtgggacggcctgagcagccagtttaccttggctttccagatgggcattatggttgtcgtgtgcgccacctgcgcccgcagtccacaggtgaaccgtctgctgaacaagatgtccagcatggtacacagccggactacggcactggtgctgatgatgatcttcggctatgtcacctctatgatgaactatgccttctgcaccatagttactcccatcctcgccatgcagcttgccaagcatgtccgcggcctgcacttccccatgatggtggctggtggatatacctgcatgattctgggtcagtgcctggggccttccgccaccctgtattccaatctggctactgagggcagctcttatgctcagattgtcggccagaccatgagtgtggctgagacttgctacaaccccatgaatatcatcctgtttacggttctggcaatcgcatttaccgttattgtcgtgtttacccgccctggcgaagacgagctggtggagctgcgcgatgtagccacccaggccgatgtggagccaaagagctataagagcaccaaaaaggccgaaacccctgcggaaaagatgaacacgttccgccccattatgtggctggtcggcgccttcatctttgcgtatgccgtctactcctttgtcaccaaggggtttctgggaagcctgaacatgaattttgtgattttcctgtttgtgggtgtcaactgcttcctcttccctgagccgcatcagtggatggaggcccacacagactccatgcatctggccacggatatcatcctccagttccccttctatggcgctatcatgggcatgatgtatctggacggcggcttgggttctgtgctggtcaatgctatcacgtctgtcgccaccgctcacaccatgccgatctttaccttcctgtcggcctgcctggtaaatctgtttatcccctctcagggcggacagtttaccgtgcagggaccgctgattgtggaggctgcaaaggccatacccggtaccgacctggtcaactgcctcaatgcgtttgtgctgggcgatgagtgtacgaacctgcttcagcccttgtatgtcatccctgccctgtccgtagttggcatgaagctgaaagatgtatggggctttatggcatttatctgcgtgttctggattggcatcacctgtctcggcctgtattttatccccatgtttgtctgaatgaaacgcctcatcacgagttaatgctgggaacatacccgtgctgttgcacccccttatttgagtggcaactagcagccggtgaatgctcctgctgtctggctggcgcttaagtatcggcactccttggaatgatcaaaaaacgtttatagcccttctcaaaaagcagaaccccgtcagaattcacagattctgacggggtttctttcgcggcctgattcctttccgtttttgtctgacccaaatgggatttcagagcagtctccacgtggctttggccgcctggcgctgggagaccgtggtgacatgggcgcagggttccggggtaaaccacgcagagaagtccccggacagccccacccgctttagcacttggtgaagcatatgcagaacactgtccggggaggccggcacaccggcaggacttcggtttccttacctccgttgatacgggtgatctgccgcttaacccggaggtcacccctctccaaatcaatgcattcccatttggagcccggcagtcctcaccgacagagtccagtggctggttctgggtacaccaatacgccgcccttttttgctttccgcaggagggattgggggtgctttaacgacagaggcttcatcgcctggtgctccagcctgggcagggtccagcttttcggcggggtggcggggaccagcctttgcgctctgaccaagttcattacagaggaagtgatctggcggatattttgtactatcttgggacgcaggcctctgggctgttcctacgctcaagccgttctatccgtccctcgggcagaaggtccttgtagagcttctccagcgggcacctctcaacattgggcctagattgtcaatatagccctcagccaaaggtggatacgggcttctgcccataaaagctgtctaacgaccgcccgcggtaagttaaatgctccgctatcccgccaagtggtaaaaaacagcgcattcacagcaagcggcgaaaggcaggcttacagaggcggggcatctgcataggagtcccgatagcgacggcgatactccgccggggtcaagttatagtttaactcaaaaattttatagaactgtggtatagaaactaactacacttttacctgcttctaagtgctgttaactgctgtaataccaatggttttcagaacagataagagtagttaaaagcgggtaagtgtaggtaattcgtatattatttctgtaccattcatacaaccatattcctacacttcttgatgtggttgattttatttctacacctatactcctacactgaaagcgagcttggcaaggtctattttattttctcaatctcctctcgaagccaagtaaattcgcggcgcgtgtagaccttttctgtgatgtcggagatcttgtgacctaccatatatttgatggcatactcatccaccccatagcgttttgccatggtcacaaagtgggtgcgaccatcgtgaggacggtgctcggggtttagtttcaattcatcacggatacgctcgaaggctttctgataccgagcataggtcaactcaaagttcttcttgtttcggttgttggggtctgcccagttaagcagatacgggcttccgattgcttctgcttctcgatattttttgagtaccaggtcctgaatacgggaatgaatggggacaacacgattctcaccggcatccgtcttcatgccgccttgaaatgtccagctctctaaatccacatcctttagttccagtagtcccagttcctgagggcgccagccggagtagcactggataagcaggatgtcgataccatgtttctcatcgatattattccagagcaattccatttcatcatctgtaaaagcgatatgccccttctttactttctggatctctttgacggtttcttccgtgaggttgaaggttctggaatagtttcgatccactaactcatattccaacgcatagtccagcatcatgttaaacatggatttgatttggttcttcatggtggctgttggatgctgctctctgcctcgaacagtggccacgccctcttccatgcagccttttacatgacgggctcgaatgtccataactcgcatcttgtaaactgccgaacagtaaggccaggcactggtcaccgcctttgtactcttgacggtcttttcgtattctggaagccacttgtcatagagctcctgcatggtgatggctgttccaaggtcatatggattcttgttatattccaccagagcggcataggcatcgttataggtggcgaagtatgattctggcttgagcggtttgcaaatgggtctgccatcagaagttttccccacagttaccatggctcggaatggatttctcaaattacgatttttgatctcactgatctgaccaaagccattcggcaatcgccgtcgcttgttggatttgcgaggtctttttattttttcagaaggtttcagaggatatccgcaatgaggacaggcatttgccttatcgctcactggcaattcgcactctgggcattgggtcagcataggtcatccctctttttcaaggctttaatttctcggcgttcgattttgtcaacgatacggccgcctaccgcatggagtagaaaaacgctgcccgcaaatagtagcgcaccccaggctcgctgatttttgttgtactcttttacgccgccctgcatagtatagacttcatgcaaatgcttggctgggttcacgtgtttcttcattgggtgtctcctttcgcaagatttacagtgggttttatggaggtgttctatatgaaatacatgacgaatgcacaaatcgacgagcttaatttgcttttggataagcatggggcggctttgacagcattttataacgaaggaatgagacaaggcgccaaaaatgtgatccatggtatgatgattggcgcggcgattattgctggcgttcagatcacaagggcaatcatcagagcacacaagcaaaagaactaaataggaattggggtcgcttaatcagcggctccttttctttttgccccttgcgccgcccgctctaatcatatatgataagtgtacgaattgtcaaacatattcctacacaatatttttgattaagatttgagggctggatatggtgatgaacgagtgctccgcctgtccccggtgcggcggacggttgaaatactacgacagcgtgcccagactggtacggacgaaagggcggcaaacctccagagttcccatgcgccgcctgcggtgctccggctgcggggcaatccaccgggaactgggcggtctgttcttcccctacaagcagtacgaggccgaagtgatattcggcgtactggaggggcttatcacctgcgagacactggggttcgaggattacccctgcgagatgaccatgctccggtggctttcgcagaaagcacagctcctattatggagaaatccataagcgaaaggagtaaatgagcatgaaactgacacctgtggaccagataccgaagatgaacggctatcacaagctgcaagagctgatcgaggagtttacgaacggcgacgctaagatcgtaaaggtggaatttagcgagaccgattataaatccccggcggtctgccggtcttgtctggccgcggccatcaagcggtcgaagcgtccggtcaaggtatggcgtcgtggaaatgagatattcctgagcagggatgtttgacaaaggatcgagccgccgtaacaggcggctcttttctttttcggacgcaggaattgcacagccctttatggaggtgatttcaatggacaaaatcaaagcactcaacaccaaagtcatggcaaaagacttcggacgggtaggcttgggcacactggccattgcagccggagcatttctgtggggcaagtttttgtacggcagaggtgtgcgcggctgccaacgctggatgtgcgagacgtttccggacgaatacgaaagcatgacggaaaaggtcgctgatatgctggaacaggaccattgagcaggccaaaacagattgagacgctctcgcggcggctctttcttttgtctccggcggttatatttctaatttagattagcccggtttaacctaagttagaaaacgggccccgcagatttcgcaattcctattatggaaaggaaacggatagatgctggtggaaatccagcggtgagacacgaaggcgtgccgccaagtaataacttaataaaagatggcacccaccgggcaacggttttcgttgggccgaccctgaagtcgtttccttttcttttttttcgcgccgattcaacaggggcctttatggaggtgaaggttatggacaccaggaaaattcttagtgcgatcggaacattcgcggttgtgggcgcggtatccacggcaggcgcggcactatggacgaaggttctgaacaggaagtttcaaatggtacagctcaaactgacacacccgaagtcagacaaaattatattcgtcgacttcaagaaggcaaagaggggccgctgacacagcggctcttccctttttatccgcacaaaaggccgtctcctttatggagacaaaactttttaggaggtaatcaagaatgaacaagcagaaatggacagagaagccggtcacctggggcggatatctcaaactcagcggcattgtgacagtcatcggcgcgattttcagcgcggtgtatatcattgccatgtttgagccggcctggtggatcgggattcggaagacggttggaaagacgttcaaccattgggcccggaaaaggaatcgtttctaaagggcgggagccgctgtaacaggcggctccttctctttttctttccaccgaggttgtttttacgaaaacggggctgcgcccttagaatagccgttgaaaggaggcagacgccgatgaatgaacaagagttccatccgggctccgtccctgtggcggtggtggcccgtgtttatggaaaagacgcgtcctgggtgagggccggaattatctccggctggctgcccatcggcaaggcgacccggaacggcaatctggtggccagcattgaggagatggattcccggtacggccggatcaatttctacatctcgccaaagcgattgtacgaggaaaccggatatttctggagaggagaacgacgatgagaaatgacatgcgtccggagctttcgcagaagaacccctactggatcggcaagcaccgctactacgagctgaagcatttctgcctacaataccccatttggaaaaaggcccgactggccctggatgggctgagtaggcggccggccgacctccaggtctttgtgagctgcgggcaggtgaagggcgacccaacagagcggtgcgcccagtcccggatattcttcggggagcgcatggagatggtggagcaggcggccatcgaggcggagcccgacctctactcctatctgctgcggggcgtgaccgaggggctgtcctacgatgcgctgaagatgaagtatgatattccctgctgccgggacgtctattacgccgcgtacagacggttcttctggctgctgagcaagaggagggattgaagttgcgggttgtggacgtggctgtccggcaatgctaccggttcaactgcccgaactgcgggagcaggctggaggccgactgcggcgatctggtggacatcggcggaaagacaagccggttctggtgcccggtctgccggaaggagcggtatgttccatggagtgccctaaggaaacgggttgtgtacgaggacaagtctgcggaataggcaggctcctttatggaggcgaaatgccatgaagaaaacgattttggaaaaggtggcggacaacaagttcaatgctgtgaaacagttagtccgattcattcgggaaaatgacaagaacccgggtggatttgaagacttatgggaaaacagttttgcgcttgaggacgaattagatgaaatcatacttcggatagcgcacatcatcgaattggaaaaagcattagaagaatacgaagagtaaggattgggcctgcggaaacgcgggctctttcctttttgtatttcgcagaaacggcagcggctattatggaggtgataccattatgacttacaagcaaatcgaggcaagccgggagctgaggctttggatcgggcaggtgatcgtgcccgccgttacgatggcggtcgcattggcgtccattccggaggttaggaacgcggcttccacaaagctggaacagctgaaatggaaactcaaatccaggagcaagggctgagcaggccctttgctttctattttccatacgcagccggccggaaagcgtgttagagtgatatcctgaaaaattcccgggtgaaaaatttaagaaaacagcgtcaaaggaggaattgaatttggagattattgcggcgattgcggcgctttgcatcggaattttgatcggtatgtgtctgttccaggatcgtccggtcggcgacctgcgggtggaccattccgatttcgcggacgaaggccctcatttatatcttgagctggatacggatatacgggccgttatgcggaagaaacgggtggtcttccgggtcaaggtggaggacttcctgccgcacgaataacatcggctattatgaagccaattctgatttttgaaaggagaaaaagcatatggcagagatcaaaacgttgttggatgatgtgatcgagacggagctcgcgaatctgcggacccttccatccggaaacgaggagagagcgaaagcgatccgggatctggcggcgctgcacaagctgcgtatcgaggagatcagggcccaggccgacgtggatgagaagtccgagcggcgggagatggacggcagacagcgcagggaggagcttgcctgcaaggatgccgaccgcgcccgtgaggaggagcttcagaaccgtcagcttcgggagcagaagatcgaccggtatgtgcgcattgcggtggccggcgcggaactggtgttgccgctgatgttctacggcatctggatgagacggggattcaagtttgaggagtccggggtttactcgtccaccacgttcaggaatctgttcagccgttttcggccgacaaagtaacgaacaggctcgaaaagaaaatgaagaggccgtgcagacagcacagtctcttcgttttatccgcgagttattcggggcgttttatggagaacacccgatattttcaaggaggtatctgtttatgaaatggacggaagaagaaaagcgccaattcattctgagggtcgacattggccgagcacgccgcttatacgacgaagggaaaaacgcagaggagattgcggcggttgtgaggcggcctgtcgcgctgatggaaaagtggattaggaacttcaaaatcattgaccaaaagagacaggcaagaaacgggtgaaccccaaaaagcagggccccagacaagggctcttgctttttaatccgggtcccaaccggagcccatgtctttgatttggtcttctcctgtcccccaactggcgctgatgtcgggaagagcgcaatcatagcaaacattggcgtctgggtattgatcgtcgtaaacacccttataatattctcgactgagctttcgtctcacggcggcaacatcaaactctttgccgcattctatacaaacagccatattcgcccctccatacataaaggatgtctccattttaccatagtcctcgccaaatttacaaggcgttttatgaggagagagcgctctttacctcaatatcagccggagccgcaaggcccggacgacttaggaggtaatgcaaatgcgtaagaagggtaaaaaggtcattcggccggcaggagatgaactgatggactacctgaaccgggggttcgcgatctgtaaccggtgcggggcggtgatggaccagagagaagacccaagaggaggttgtgatatttacgcctgcccgtcctgcggatgggagattgacgagatggagtacgagtatgagagcggagatccgatggagctcgtacaggatgaaagaggcgacgactacctggtcttccggaacgacatgccgcccgccgggtgcagagcgtgcggaggcccatacccctactgcaagccgtcgtgcagaatgttcgacgactaagcatgaccaacgtagaggaggagccctgtaacaggggcttttcctcttttatatttttgataggcgcagaaatggcagagtgtattatgagaaactattttgaggaggaaccagtcatggatattacgaaaaaagtagcggcgttgaggttcaaataccacgcaaacatgcttgacgtctgtaatgtgctgaaccaaatcggcattttgaaggacgaaaaagcagaatcggtgatgaaaaatcatacgatgcagtgctttgattgtttggaacgattaggttatcccatcgaaaaatttctgaaagagcaagagaaggagtcctgatcggggctctttcttttatatttggaggcagacatgcgctatcactacgagaagccgcccatttatctttccatgtacggacagcgctactgctgcgaccatccggtctataaccactgcaccctgttccttgtcggcgaacggggcctggcggtgattcagcagcggtacgacccggagacgaagcacaccttctgggccgaggtagacgagtggctgacggacccattatatctgcacccccggtttcgggcgttctttgaccgccgggccgggacgggtacggacggcctctaccccaccgtgaccatccggcagatcatgtgggcgctgaagatgaagcccctgcccaagcagccctgggagacggtcttcgaccatacgccgatttgacaacctcctttatgagaaaccaactgattttgaaaggggttgcggtttatgaaaacattcaagaacaagctgtacgctgtggggctgatgctctgcggaagtgttccgacattcctggagcaggacgccacggcgctggtatttatcgggatgattgccgttccgctgttctttgcaaaagaaaactggatttattaaagggaacggcccggacaagggcttttccttttatatttgcgcttatttcgcagctcctattacggagaacgatgctcgtaaaaggaggtaaaggagcatggacgaaatgagactggaatcgaaatttacaacaggacttgtatcaaaaatcgcaaggaccgttgtgcgtaagaagctgggctacgatatggatattcggctcaaccggctgcggacaacggtggttgatgaaaagacacacgtacatctggacgtcgatctggagctcacgaaggaagagcttgacaaattattgaagagcatcgggctctgaggcaaaggccccataacaggggctttgtctttcttccgcagattccgcaggttctattgtggagaggcatacagcgagctacgaagcgagggtggtagtaggcaacgcaagacggaaacccacctgcctctcttaggttttcgcagattttgcaattcctattatggagaggaagttagctcagtggtagagcgcaggctgaaatgcctgaggccgccggttcgagtccggcactttctctttcgcttttgcatggagaaaaaaacaagtttggaaaggagtttaccatggagaaacggccgctggacacggagcttgaagttctttggagcgagcacctcgaagacgatgtgttctcagtacgcgcttacaatgttctggcgcatcgtctcggtcttcgcacgttaggggatattttgaatttgacccgcgacgacattgcaaaggcgaggggcgctggggaaaagaccctggacgacattgcgaagctggttcggtcgtgcggatacgaactgaacggatttacggacgccggtccggactgcaaaaagtgcaaacagagggatttcctgcggccggcgcatcagcactttttcaaattggcaagggagttcaaccgcttgtatcatcatcccaaggaccgcgcctttgtgtttccaaaccggatttccggagagacgggctgggatattgtaaagcgggccatattcgccacctataacgtgtcgagcattgcctctctgccagacggggagcaggcgaaaatcaatgaatttgcgatgggtctcacggatattctgttccaacagctgcgggaccgggcaaaagaatacaaacggagcaatatttgaaaggagaaaatgagcatggaagttaaaattgtgggcgagatcaagttcaagacctgtaccctcccggtgtatcgggatttggacgagcccctgttcaaggcgggggacgtcgctgagctgatggactatgggccgaacaatatttggaacctgaccaacctttgcgaagaggacgagaggctggtgctgtcatcggaagtggcgggtcaacaccggcgggtgacgttcctcaccgagagcggactctacaacgtcctcgcccagagtcggaagccggttgccagggcgtggcggcgggtcattgccgaggagctgattgccctgcggcggtcccgtggcaaaaatatctcggagcagttcgaggactgggaccacatggcggacaccatctactttgacgaggtgaccgggcggctgatgcggtcggtgaccgttcccggcggggacgtggagcaggtcccctacgagccctgacgccatgaaagcggaaattggataccccgatgtggtcatgggggattttatacaggaccttatcggcgacatcgagcataacatgcggcttgctccgcccaacgaccagtatttcgaggagctcagcattcagaaatttaccctgcaacagctgctccgggagattggcaggcatgaaggagactctcccaccgccgtagtagcgagatttgtggagaggatgtctgccacagcaaaagaggacgacccacggttcgtcttttctatctccagggacgcggcccagtccatcctggacggattatattttgactaaacggaaaaggagaaacaatgactggagaagtttacattcattatggcgcggacgccttcgacccgagccatgggtttccggtggtaaacacgaaatactcctgggcaaagccccacggaggtctatgggcatcgagaaaacgtgcgtcctacggctgggccaaatggtgcgaggagaattcctttcgggattgcgccgcagaaccctcatttcagtttatcatgcgaaatccggaaaaagtagcggtcattcataatttgaacgatctgcgacagcttccgatggtgagagacgttccgcccggcatgtgggaggaaattgactttgtggaatgtctgcggcgaggaattgacgctgttgaactctgctggtatggggaggaataccaagaccagcgggccgatgatttatatctcgctttgtatgggtgggactgtgactccattgtggtcctcaatcccgacgcagtgattcagatttaacactcgaaaggagaaaacatcatggctaagacctatcttgatattctgagcgagcgcggcgtccgccccttcctgaccgacgaggcttttgaggagctccagaagtttgactacaagagccagtacgccattcccggccaggtaatgccggtcttcaagcaccccaaccagcacaagattgagctgggcaagaccaccaatctgatcggagatatgtgctggtacggagccagcgtggaggaggtggtacgggccatccagtacggcatggtggtgctcgatgcggacaagcgccatttggactggaagaaggccgctgaggacttcggtattcaggagcttctcaagaaataccgccggttccgccgcaagcccaagctgacagagcgggaaaagctggtcattaccgcttataccggctatgttctggagggtacggccggaaaggtagtggatttcgtggaacaggagctgggtcattccattcagacgccggagccgcccgcagtcccggttgttgtggaggtgcgccgggctttgcaggaggagttctgcgagatctgccggaagcaccacatctttgattatatttaaggaggatacggacgtgaacgcaaaaacgaccctgctccacggagccgagaaagcggtcaaaaaggcggcgccgacgatattgaccgttgtcagcgcggcgggggtggtggccacggcggctctggcggtcagggccacacccaaggccctcaagcgcattgaggcggcaaaagcggtcaaaaaggcggaaaatggcggaaatttgacccgaatggagacgataggagcctgctggcaatgctatgtaccggcggcggccacgggaatcgctgtaatcgggtgtattttcggagcaaatgccctcaaccggcgtcagcaggcggctctggtcagcgcctacgccctggtcagccggtcctacaacgattaccagcgcaaggtcaaggagctccacggcatagacgcccaccgggggatcatggaagccttggccgccgaaaagagcaaaaagcagcccatctacgcgggcaccctgatcgggtcatcctctctggactttgaggacgccggcgaggaggagcggctgttctacgacgccatctcggagcggtattttcaggctaccatcagccaggtgctccaggccgaataccacctcaaccggaactttgccctgggcggaggtttcatcaccctgaaccagttttacgagttcctaggtatcgagccggtgcccggcggggacgaggtgggctggatggtttcggacgggctctactgggtggactttgaccaccaaaagaccgtggtggacgacgggctcaacggcgaggtggaatgctacatcatcgacgcgcccttcccgccggtaagcgagcgtgaatacgaggacatggagctctgagggctccgcagaaattgcatctcctattatggagaatctatatttaacaggaggtttgactttatggactcgaaaacgatatttaaggtgttgtcctttgtaggtatggccctgggcgggatcggcacactgctgtccgcctgggctgacggaagggagcaggacgcgattatcgaggagaaggtaaatgaagcactggccgcccgtgaacatggagaaaaggaaagcgaggagccctgaccggggctctttgcttttgcaggagccgctgtccatgaacgaacaggcgatcctctttctcatggaggtcctgaacggctttgaggagccgccaaggtccgactggcccaggcacgaggcggaggaagtcagcttttcccgctgggcggtggaggagctgctgcaacaggtctgggaccacccgtggacactggcctctgagacggtagagcgtttcgccgcgaagctggggctatacgccgagacctgcgtcacggaccagcagcaccggatctttcggatcgcggccgaaaccgtgaggggattcctcgatgagatcgagaagctggagcgatgaaaacattgatatttatgagaggagatggcgtcttgaacaaacaagcaatttcaaacgccctgaaagcgttgcagaaaaccgtgaaaaagcacagcccggagattttgacgggcatcggcatcgccgggatgaccgccgccgctgtgatggcggtcaaggccacccccaaggccctgcggatggtggacgaaaaggaaatccgggacggaaagcgcctgaccaccggcgagatcgtcaagaccacctggaaatgttatattcccccggtcgtcaccggcgtatgctccgcggcctgcatcatcggggccagttccatcagcgcacggcgcaacgcggccctggtcacagcctacaccatttcggagaccgcgttgaaggagtaccgggacaaggcggttgaggtggtcggcgtgaagaaggagcaggccatccgggacgcggtggccaaggacaagctggagaaggccaatgtcaaagagcgggaattcatttccaccggacggggcgagaccccctgcttcgacccgctgaccaacacctgcttcaagtcggacatcgagagcctccgccgggcggaaaatacgctgaacaagcggatgcgggacgaggtgaagatcaccgtcaatgagtttctgatggaaattggcctggagccctgcgacgactctatcggagagaccatggggtggggcatcgacaagggctacatcgagctggacttcagctcccagctggtggacggcgtcccttatctggtgctggggcaccgggtcccgccggtctatctgggctggtgacatccgcagaaattgcatctcctattatggagaaccatccaatgaacctaactttacaaggaggaacttgacatggaagaaatgaacgcaagagtgatggagaacgaggttatggacgagaccgtggaggtcgatgaggccgttgacagcggaaacgctggcgcgctggtcgcaggaatcgtcggaggcttcctggcttacgccgtgattggcggggcgaagaagctctgggggtttgcgggcgccaagctggccgagcggaaggctgccagaaaggccgggaccgacgcggtagacgtcgagtacaccgatgtcgaagagactgcggaggattccgacgaggggaactctgaaaagtaagcagaagagaggttcgccgggggagagtacctgtttcaggtgctttcccttttttgcttttgaaaggagaaaattgcatcatgagaggtattttgaagaacaccctgttgttattgggcggtatggcgctggggagcctggcgacacggagagcgatccggtatgccgtggaaaacaggtacgaccgtgtgaagtacgaagagcccatctttgggaccggggaggacgccgagcaggtgctggacgggctcaagaccctcatcagcacctacggcaacgcaacggcggcggatttgtatgagctggccggcacccacgatttcaaatacgagatgacaaggattggctggacctccgtggacggggcggagatcgtccagacggacgacggctatatcatcacactcccccagcccaagcccatcacttacaaggaggaaccgtaatggcagagtatcccaacaactcccacagtgcaaggaagagaacggattctaccgcaccgggaaaagcggaaaagaagctggaaaaggtggtgaccggagcggccaagacccggaagaagagtgaggcccggaaattcgtcaacatctttgtcccggaggacggggagaacgtcaagtcctatatcatgatggacgtgattatccccggcatcaagaacgccatcgccgacgtgatcagcattgtgctcttcggcgactccgggcgcatcggcggaagcaggagcaagcgggacggacgctcccggctcacctactgggacgacaggcgggatgaccgtagagagtacggacggcccagagctgccgcgggctttgaatatgacgacattatatttgagacccgcggggacgccgagctggtgctggatcagctggaatcggccatcgccaactacggcatcgcgtcggtggccgacctctacgacctggcgggcatcacctgccgcaactacaccgccaaccgatacggctggacggacattcagtcggcaaaggtcatccgaactagggagggctataccttgcagcttccaaggacggtccagatcaactaaaaggaggcggacgccatgtgtggatatttgacctccagcggctacaagggtctggtatgtggccggtggatgctgttcgccacggacaccgagtattacgaatacatgagagagcatgaggaggagcgccatgcggattaacgcggattcatttgtaggcgtcggcatctgcattttggggcttgtgggcgtgggctacgccatcggcgtccactccaaaatgaaggtgatgtgtgaccggctggataccagcatcgacaacctggccaacaacaccgagattgatattcccgcaaaggtcattgaccaggcggttcagaaggccgtagagcgggagtcctattccgcggtcaagcgggccactgaggaggtcgtggccgacgcgaagcgggagatcgagagccgggtgggcacggcggtaaaggcccagtatgacgcgatttcggacggcgtggcggatcaaatcgccaagaatgtcgcccggatcgacgagagcaagctcaagaaggaggtcgtgcagaaggccaaggagcagatcgccgagaaattcgacgacaagctggacgacctgctggaggagttcaacggaaatctccagaacgtggggaaaatctataaatctattgcgagatcattttctaaggaggatatttgacgatgaaaaccaatgaaatcatgaaatctgtgagcctgaccttcaacaaggtggggttccggcttcagaagaagagccctgaaatcctggtggccgccggcgtggtcggcatagtggtgagcgccgtcatggcctgccaagccactcccaaggccctcaaggtggcagagaagacccaggacgacgtcgaacggattcagagcgccgaggattccggcgttacccaggccggagagacctacaccaaggaggacgcccgcggcgaccgtatgcaggtctacgcccacaccggcttccagtacatcaggctgtatgcccccgccgttctgctgggcgcggcgtccatcacctgcatcctcaccagccacaagctcatgagaaagcgcaacatggcgctggcggcggcctatgccaccctggacaaacactttaaggattaccgcggccgtgtgctggagcggttcggcgagcaggtggagaaggagctgcgctacaacatcaaggccaaggagatcgagaccacggtggtggacgagaatggtaaagagaagaaggtcaaggagacggtggacgtagccgccgagggctgggacccctccaagtacagcccctatgcccgtatctttgacgagggccaccccgcctacatgaaggatgccgagcggaataaatattacctgctggcccttcaggcccaggccaacgaccggctcaagtcccgcggccacctgttcctcaacgaggtctatgagatgctgggcttccgcctgaccaaggccggcgccgtggtgggctggatctatgaccccagagagcccatgggggacaactttgtggacttcggcatgttcgaggtgtgccgcgagaaggcggtagatttcgtgaacggctacgagcggtcttttatcctggacttcaacgtggtaggcgacatcaccgacgcgctggccacccaccagacgctgtgagggctgagccatgaagaaatttttggcgaccctgctgcttgcagccgtaatgctcaccggagcgtccttctgcgtggagtatgagcctgccgccgctttggagccggttgtcaccccggtccatgcggttgcggaacaggtcaacctgacggagaaacgggctgatattcctcagcctgtggtctccaagccccctgtcgtccagccggaggaaccgatggaagagcccgacgccgtcacgctgacccaggaggagatcgacctgatcgccctctgcgtgatggcagaggcggaaggcgagccggaggagggccagcgtctggtcatcgacaccattttgaaccgggtggacgacccccggtttcccgacaatgtccacgacgtgatctatcagaagaaccagtttgccggcatgtatggagagcgtatcgagcgctgctatgtgaaggaagagctggttcagctggtccgggaggaactggagaaccgcacgaacagcgaggtggtcttcttcaggaccagccactatcattcctacggcgtccccctgttccaggtgggggcgcattatttttccagttatgagtaaaggaggcgcgcattatgaaaacctgcatcaaagccctgctgtcctacgccctggccaccgtatcgggactctgcctggtcggcggcgtcaccattttgtccaggaggtaagcggtatggagggatttgcaaatctggtgtccatgctggactacgcggtcaacaccagaagaaaacgccacatcaccggcgggctcctgatcagcgcggcgctgctgttcgggggccttgccattaccgtcatgagcactaaagacgaagaggaggactacaatgagtaaacttggcacagcgctggcctttctcgcaggcgccgcactggggggcgtttccgcatggtatgtcgccaagacgcggtacgacgagctttccgagcaggagattgactccgccaagcaggccttttatgccagggagcagcagctgaaggaggagatcgccgctctgaaggagcatctggccaaagaggacgagccggaggaggcgcccaaaaccgttttggcggccaacaagaaccaggagaagggcgacatcaacgactacgccaagatggtcagccgggttggatattcccgcacctcggtgcccccgaagccggagcatgaggtggaggccccctatgtcatctccccgaaggaatttggggagatggatggctacacccagatcagcctgacctattttgacgacggcatcctttccgatgagaacggggtcatcatcgacgagccggaggatattgttggggacgctctgaaccacttcggggagtacgaggaggattccgtctttgtccggagcgaccccaagcggtgcgactacgagatcctgcgggacctgcgcagctacgcggagttccgatccacccttcctccgaaaatttgaaagggaggtctgacgcttgacccgggatgaactgattgaccagtattttgactggatgtatcagctcgtggtcgacgaccgatattctaacaagtcctatcgtaagctgtttgcgcggctttacgatacggaattcacctatacgattccgatggacggcaaccgggccgaagacggcatcgaccttagatatcggttcggtcgcgagcaattatattctgacgccatggtcgcgtcctgcctggacgaccgcccgtgcagcattctggaaatgatgatcgccctcgccatccgctgcgaggagcacatcatggacgaccccgacgccggagaccggacggggcagtggttctggagtatgctggtgagcctggggctcggctccatggacgaccggaagtttgaccgatattttgttgatcagacgctggagcggttcctggaacgcgggtacggacgcaacggcgaaggcgggctctttaccgtggacaacggccgcgacatgcggaacacggaaatctggtatcagatgaactattacctgcgcgaaatcatcagggagggaggcatttagcatgagtaaaaagggaaaattcgtggatatctgcacgctggaggacttgacggccctggtaaaccacaacttccaggcctttgagaagcgggtggccaagctgagccgtaaaagcagcatgttgaccgtggtcgccgttgccgcagttgtgggcgtttacgccctggcggcggagaaccggaagcgggaggaacaggtctaccagctttcggtccgtgtgaaaaagctggagtatgataaaggagagtaagtgacccgatgctggacttcttgatgatttcaacgcgcagcgggaaacgcggcatcatcgagatctatcccaagtttatcatcaagaaaagtagcgacctcatgatcagaggcggcgacttctatgcaatctggattgacgaacggggtatgtggtcgactgatgaacaggacgcggtcgacttgatcgaccgtgagctggaccgatacgcagaagaaaaccgcacgcgctttgacggcaacattcgcgtcctccatatgtgggacgcggaaactggcatgatcgacacctggcacaagtattgccagaagcagatgaaagaccagttccatatgctcgatgaaaagctgatattctccaacacgaaagtgaccaagcgcgactacgccagcaagtccctcccctaccccctggagccgggggagactccggcgtgggagcgtctggtctccacattatattctcccgaggagcggcacaagatcgagtggtgcatcggggctatcgttaccggggagtccaagaagctgcaaaagtttctggtcttctatggagcggtgggcaccggaaagagcaccatcatcaatgtgatcatgcagctcttcgagggataccacaccagcttcagcgccaaggacctgggctcctccagcaacgcctttgctctggaggccttccgcgccaatccgctggtggccattcagcatgacggcgacctctcccgcatcgaggacaacacccgcatcaattcgctggtgtcccacgagatgatgactgtcaacgaaaagttccgctccgcctactccaaccgctttaagaccttcctcatcatgggaaccaacaagccggtcaagattacggacgcgaaatccggcgtcatccgaaggctgatcgacgtgacgcccaccggggacaaggttccgccggacgagtaccggaggctgacccggcaaatccccttcgagctgggcggcattgcctatcactgtcaggaggtctatctggaggacccggactactacaacgattatattcccatcgccatgatgggggcctccaatgacttttataacttcatcgtggactcctatcatgtgttcaaacgggacgatggcgtgtccctgaagtcggcctgggagatgtataaggtctactgcgaggacgccaaggtgccctaccccgtctcccgcatgatatttaaggaggagctgaagaactacttccggtgttacgaggagcggttcagcatgggggacgggtcccgcgttcggaactattacagcgggtttcggacggaaaaatttgaggaacaggcgccggaggacaagccggtgtcgccccctcaccccaccatcgactttgtggaggggcaggcttcggcgtttgacaaggactgcgccgactgccccgcccagtatgcaggcggagaaggcacgccccgtaacaaatgggagcgtgtccggacaaagctgtccgccctggacaccagcaagctgcactacgtcaagctcccggaaaaccacatcgtcatcgactttgatattccggacgagcagggccagaagtcctttgagcggaatctggccgaggcgagcaagtggccggccacttatgcggaggtaagcaagagtggctgcggcatccacctgcattatatttattccggagacccgacgcggctcagccggatttacgacgaccacatcgaggtcaaggtctttaccggcaacagctccctgcgccgcaagctctccaaatgcaacaacctgcctatcgctacgataagctctggattaccgttgaaaggagaaaacaatgtggtaaattccaaagtcattcaaagcgaaaaagggcttagagttcagatcaagcgaaacctcaataaggaaatccatccggctactaagccctctatcgactttatccacaagattctgacggacgcctatgagagcggtatgccctacgacgtcaccgatatgcgcaacgcggtcctggccttcgccgccaacagcaccaaccaggcggaatactgcatcaagctggtgaataagatgcccttcaaatccgccgaggacgggcagggggtgaaaaacgacgaggccaagctggtcttttatgatgtagaggtattccccaatctgttcctggtgaactggaagatcgaaggccccggtcaaaccgtggtccggatgatcaaccccaagcccacggagatcgaggagctgatgaagttccgtttggtggggttcaactgccgccggtacgacaatcatattttgtacgcccggctgatgggttacaccaacgagcagctctacaacctgtcccagaagatcatcaacagcgagaagaaggcccgaagcaccaactgcttctttggggaggcctacaacgtctcttatacggacgtgtatgacttctgctcggtcaagcagagcctgaagaaatgggagatcgagctgggtcttcatcaccaggagctgggtcttccctgggaccagccggttccggaggagatgtggcagaaggtcgcggaatactgcgacaacgatgtcattgctaccgaggccgtctttaatgcccggaaagccgactttgtggcccgggagatcctggcggacgtggccgggatgacggtgaatgacaccaccaactccctcaccaccagaattatatttggcggaaacaagcgcccccaggaccagttcaattaccggaatatgggcgacacgacgcagatctatgacccgaaccgggacctgccctttaccatgggagaacctgagttcgacgagttcaccgcctttgacaaaaagggacgccccatcttccccggatacaaattcgagggcgggaagtccctctatcgcggtgaggaggttggcgagggcggctacgtctatgccgagccgggtatgtacggcgacatcgccctgctggacattgcctccatgcacccctccagcatcatcgcggaggagctgttcggccccgagtacaccaagcggttccaggagatcaaggacgcccgtgtggagatcaaacacaagaactttgagaaggcccggaagatgctgaacggcgcactggccaagtatctgacggatgagggttcggcagacgctctggcccaggcactgaaaatcgccatcaactcggtctatggcctgacctcggccaacttcgagaatcccttccgggacaaccggaacaaagacaatatcgtcgccaagcgcggagccctgtttatggtcaacctcaagcacgaggtccagaaacggggctttactgttgcccacatcaagacggactccatcaaaatcccggacgcaacgccagccatcatcgactttgtgatgaagtacggtgagaagtacggctatacctttgagcacgaggccacctacgaccggatgtgcctggtgaacaacgccgtttacatcgccaagtacgccacggcggagaaatgccagctggcttacggctatgtgcccggtgatattcggaaacaccccggcgaatggaacgccaccggcacccagttccagatcccctacgtgttcaagaagctgttctccagggaagagatcgtgttcgaggatatgtgcgagaccaaatcggtcaccaccgcgctgtacctggatacgaacgagaccctgccggatgtatccgagtatgagaaagagcttgaaacactgcggaaaaaatggccggacaaagagggacagtaccccatggattatgacgaggtcgttgcggatctgaaagccaaaatcgaaccgggccacaattatattttcatcggcaaggttggctccttttgtcctatgaaacccggctgcaacggcggtctactgctgcgggaggtcgtggacaaaaagaccggcgaaaagagctatgcctctgctggcggggccaagggctaccgttggctggagtctgagatggtcaagcatctgggtaaggaagacggcatcgaccgggggtactacgatgccatggtggacgccgccgttgcggatatttcccaatacggagacttcgagtggttcgtatccgacgacccctatgtgaaagcggacgatgacacgccaccctggttcggccccggggagccctatggcgatgacgctaccgcctttgatgtgaggtgaagacgatgagcatcgtgctgattatattctggttcgacgttctggctgcgttcatttgcgccgccaccgagcggttcttcctatgcggcgtcaatgtcgtgttggcggttttgctggctttcatagccatggtttatgaggggcgtctactgaaccgcgtcaagaagctggaagaggaagtcgcattgctccgcaggggcacgattatctgcgaacacctttcccaaatcaacgataaataaaggagagttttattatggctaatcccagagtgaatgagaaccttgtgatcgagaacgcccgcctgctcttccggaacttctccggcagagagagcaagtacaaccgcgccggacagcggaacttctgcgtctacatcgaagatgccgcagacgcccagaagctgatcgatgacggctggaatgtccgtgttcgtccgccccgtgaggacggcgaggagccccgctattatattcaggtggcggtcagctttgagaacattccgcccacggtctacatgattaccaagcgcaagaaggtaaagctggacgaggagtccatcgacaccctcgacttcgcggagatccgcaatgtggatctgaccatccgcccctacaactgggtgattcaggagggcaccaagaacgagaagagcggcgttaaggcctacctgcgttcgctgtacgtggtcatcgaagaggatgagttcgccgagaagtacgccggcgacgagtatccggaggagtaagaccaatgcgggggcgtcggtgaataaggagatagccggcgccctctcctatttttgaaaggagaaaaaccatggcaaatgaggtaaattgccgcatgatttttaaggagggtgtggaatgaagccattctggaaaaattcccggaagaaaaaaacgaagaaacctaccactcctctccagcagaaaccgagaacacgggcaaaaccgaagtccatggaggaaccgtggaaacctcccatggctgttccgcccaaagcgatggggcaagaaagaacacccatcacacagatgctggaatcggctcgtcccgcccggaaagagtacattccagccaggccatcgacgcgaaagagcgagtattatcacgagtttcgctccaattttcagcagctgctttctccaaaatgtcgcccgattgatatttggagggatttcatcgtcatggtggcctgcgcaatgtccaataccgtggataaagcccattatgatgagcgggagaaacggtatctggaaatcatcaacaaatacgaagaatctcagcagcatattttccccaaactctatgccgctgtggtcctggctctggatgaaaacccggaacaggactttctcggcgagatgtttatggatctgcacctcgactatgaggagctgaaacagatatttacgccataccacgtgtgccaactgatggcggacatcacgatggacgaccttgttgagcagattgacaagcagggctatgtttccatcaatgactgctgctgtggagcaggagcaaatctaattgccgcaatcaattccgcccgacgcaaattggaagatgcgggcctgaactttcagaaccacattctgatcatcgggcaggacatcgaggaactggtggcactgatgtgttatattcagatctccctgctcggggtcgctggctatatcaaggtcggaaacgcccttacggagccaatgacccctggcgacagcatggaaaattactggttcacgcctatgtatttttctgacgtatggcacacaagaagaaccattcggacgtttatggatttatttaaggaggatgcgacatgaataaatggccaagatgcgaggactgcgtgcgcgacaattaccttagagcgcccgtctgtcaaacctgcgttgccggaagcaattttttgccccggggacgcagcaagatttactacgagtctgtccaggagatgaatcagccgccggcagcttatcgcgctatggttcaggccttgcggaggtttgacgatagcgctcttgttccggagattctggacgtgatgttcaacgagccagccactatcgtcttctgggccgatggcaccaaggctgtggtcaaagccgtttacgacgagttcgatccggagaaggggcttgctgtggcgattgcgaagaaagctctcggcaacaagggcaactactacaatgtcattgcaaagtggacggacgagtatcttgagaaagaggacaagtgatgccccgtggccatccagttatatgactaccagctcgaagctctgaatcggatgaaaaacggctgtatcctctgcggcggggttggttcggggaagtcccggaccggcctcgcttattactatgtgcaagagggcggcaaagtgggtacggacgagtatattccgatgaagaatcccagagacctctacatcatcaccactgcacgaaaacgggacacctgtgaatggcagggcgatttggctccgttcctgctctcccccactccggaggccaactactacaaaaacaaagtggtcatcgactcctggaacaacatcggtaagtacgttgacgtcaaggacgccttctttatctttgatgaacagcgggtggtggggtatggcgcctggaccaaggcgttcctcaaaatcgtaaagtcgaatgactggcttctgctctcggccacgcctggcgatacctggcaggattatattccggtcttcatcgccaacgggttctaccgcaacaagaccgactttgtggaccagcatgtgatctacgattggagggccaaatacccgaaggttgacggctaccgcaataccggaaggctaatccggcttcgggacaggattctggtcaacatggatttcaagcggcagacagtatcccatcatgaggacatccgggtttcgtatgatatttccaggtataaggacatcatgcggacgcgatggaatccctgggaggacaggcccattgaaaccgcagccgaactctgcatggcgcttcgccgggtgaccaattcggatgaatcccggtctgttgcgatactggaaatcatggaggaccaccccagggccatcatcttttacagctacgactatgagctggatattttgcgttcactcgggtatccggagggtacggaggttgcggagtggaacggtcacaagcaccaggaaatccctaccggaaaaaagtgggtgtacctcgtccagtacaccgccggctgtgagggttggaactgcattaccacggacaccattatattctactcgcagcagtattcctataaggttgccacacaggcggccggacggattgaccggctgaacacgccctaccgggatctcaactactaccacctgaagagcttttccgggattgacctcgccatcagcaaggctctgtccaagaagaagaacttcaacgagggcaagtttgtcggttgggccacaaagccgttggaggtgaaccccaagagtcatgaacaggaaagacgtcgcagagctgcttaaccgcaggcggagacaaattctcgttcacagcatcatttattacaaaatggacgataacctcatttcggatagcacctggtcggcatgggctacggagctggaagagcttcagaagaagtaccccgacatcgccgccaaggttccctatgcagaagaattcaaagacttcgaccactcgactggtatgaacctgcctttggatgacccctggacagtcaataaggcccgacagctgcttgcgatgaaggacagaggattctgcatccaatgtgagcagcttgaaattaaactctaaaaggagaaagacgatgaatgacgaaattaaatttgcgtcagaccatagcgatgttgaaagtcgcgttttcgcttttcgcagttgcatggagcctgctctgcatctgtttccggagagcatcgttgagaggttgaaaggaggcggcttctttacggccccggccagcaccaaataccatggagcatacgagggcggtctgttcgagcacagtctgaatgtgaccatctctctggtagaactcacaaagcagaatagcctgacgtggggacgcccggaatcgccttacatcatcggcatgttccatgatatttgcaagcaggatcaataccggcatccggttgacgcgactttctatggtggcggtgccccgatccctcttgttgatgaaagcaagtgggagtacgaccccgatgcggttctcaaagggcacggggagaagtcggtgatgctgctttcccagcatttgtcccttaccatggaagaaatcctgtgcatccgttatcacatgggcgcctttgtagaccagaaagagtggaacgactacacaagggcaattcatgcgtatccgaacgtcctctggacgcatacggcagacatgcttgcggcgcacatcctggaagttgacaagtgaccataccttattatattctgtctcaaaagaggtgaaaggaatgcttggcgcgattgttggggacattgttggctccagatttgaacggcataaccacaagtccaaggactttgaactatttacagaccggtgccggtttacggatgatacggccatgacggtggccatcgccaaagcgctgttggagtgcaaaggcgactataccgagctcagcgatcacacagttcggtgtatgcaggagattgggcgaaagtaccccaatgccgggtacggacagatattctacctctggctccaccataagaacccggggccctaccgaagctatggaaatggctccgccatgcgggtaagcccggtggcttatgttgccaaaacggaaaaagaatgtatccaacttgccaaggcagtaacgcaggtcagtcacgatcatccagaggggataaaaggcgcggaggctgcggctttggctacttggggtgcgatgcgtggaattccaaaaggagcaatccgggcgcacatcgaggagtggtattatattttggatttcaccattgacgagatccggcctaaataccgctttgacgcaagctgtcagggctctgttccgcaggcaatcaaggcgtttctggagtccgaggactttgaagatgctatccgcatcgcggtctccctcggtggggacagcgacacgattgcggctattgccggcgggatcgcgggagcctattacggcgtcccgaacgaccttagactgaaagcaatagagtatctgccggcagagttcattgatattctggaagactttgagagaaactattgttgaaacgcaaatcgaggccaccctcatcttcgggggtggtcttttcttattattaggaggcactgccaatggataaaaagcagctacaagagtttatcagcgccattgggtcgattgcggaaacggcccttctcttttatcggagcaccctggcagcgaaagcaactccggaggaggccatgcggctgacccaagcctttattgcggccatattttacggcaacaaaaacagcagctccactccggatcagtgaaaggagaacattatgacgattcagggatgggttctctttgggattcttgctctctttattctttcgtttggcatctttggagcaattatatttgaaaagattgtctggaaggttcttggcattgtagccgccatgctcctcatcatcggactctttgccgggatgcgctggtattatcagaataccgccagcggtcaacgggcaatgaccgaccagaaaagcgaactggacaatgggctcgaacggacggtgacgatttacacggcggatggtgagatcattgcacagtacactgggaaaattgacattgagggcaatgacggcggctacgtcctctttgactatgaggggaagcgctacacctactataactgctttgtggagtctattgcggacattaagtagggtacggacgaaaaattatatttaagaggtaagactatggctggattgaattgtgaaatcagatgggaaacccggctctgtgaggtagatggcgagcttggatatttccattgctgggaacattggtccaatgtgatagatgcgagtccgctgcgggggggggtcatcccggaggccagattaggcaagtctatggaattgtcgagtttaaggacggcgtccggcggattgaccctgcaaaaatcaagttctgcgacgacgaaaacgctattctggcggagatggagaaacacaatcgcgccggtaaattggagggtcagtaatgaaagtttgtattttatcgaatgatgaccccgcggcctttcaaagctcgatcaatgcttttatcgctgacaaaaaggtcatcgacatcaagtatcagagcatgaacctgacgctcaagtttacgaatggggttccttcggaatcaatcatcgtggatcgtgcgctcatcatctatgaagaatgagcagatagcggcagttcgttgcaaatgcggacgcccggcacatatttggcattcgcgggatggatatttatgcgggtgcatcaatccggactgcgccatctctttagagaggtcacagaagtccagagcggaatcgatccaaaagtggaatgcaaagatgaaaggagaatctcatgaataacgaatggcatccctgccggtatatcgattgtacgttggaacatgacgactcctgggtagacggaaagtggtatgaatgggaagatatttacggcaaccgtgaagtcgctcgaatgaaactcgacgccatggaccacttttatcctaataccaaaatcatcaaggaagaaaatgtccgtcgttacagagagattatggaaggagaaaactgatgttcgttgtgagagactggacgcgaaacccttcttacaccatggtaagcaacgacgttaaagacgtccgcgatattgttatcggcattaccggagatgaaacgattggcgaccatgtgcttcttcatcttgggcatatgatttttggacaatttttagtatggggtccgcttgtcatcaggtgcgttccggatgaagatgctcaggcattacatttgaaaggagaaaacgatgctgatcattaagacagcggaagaccgagaacgctgcacgtcttgttatggcaacatcatcgttgagttgaccatggaagaagtcgttgccctgttctcaggagcaacgctcggcgatccgaactttaatgaatatgggatattcattcgattagaaggctccacacctgtttgaaaggagaaactaatgggtattaagtttgaaggtcaggtcttaaaatttggcaccgtggataaatgcaatagaaaatttgccccggactgcaagatcacgttccccgagaaaatcccggtagcctacaacttcgatatggatgaaataatcggacatgctgatatttccaaggtggaggacggactcaaaggcgtggtatcattgttcgatacgaatattctccctggaaacgagtatttcgttggcggatattataccaggatcaagacgcatgtggaggattacatcaccgtcatcgattctggtagattggtcagcatgagtatcgttccggagcataatgtcgctgatgaaaatttgaaagttaggagagttggacccaatgctgaaaattgaaaacaccgaggttttgggctgggagcacgccattcatggtatgcgcaatccgatgaaccgtctccgcaacgccggcaccgaccaccggaagttcatgcggatgataacggtctatgtagacctgactggccctctgtactggtggaaggagttcgatacctacaaggtggggacggtggccaattcctgctccacaatgcacaaaattgcggcgaaggagtttacgctggaggatttcagctatgagcatttgattgataaagaggtatttgcgtatcctctcggaggtggttggagaggtctttccccaatcgagatacttaacgcaaccattgagttgttgaataatgccagaaaatactatctgagcatggagaaacaaaaagtccccaaagcaagtgagaaagccaaggaaatttggtggcagatgattcagcttctcccttcctcctacaaccagcggcgaacggtcatgctcaactatgaagtgctggccaatatctacaagagccggcggaatcacaagctggatgagtggcacaccttctgcgactggatcgagggtttgccgtacagtgagctgattactggctccagtttgaaagatatccccattagtaatgaaatcatggaagaggcaaaacgaagagtccatgaggagctgaatacccagctcgatcatttctgtaaattacatgagggttaaatgatgaataaggaacagaagtggatcgaaaagcaccccataacgtggcttttgatgcagaaaataggggagtttctgtggttctttgccaagttctctgtctgtatgcttttgtggtgggcgatacacctctgattgacactcttcggccaagcatggtatgatgaacttggataagccaaatcgactatgcgcaaaaagtgcagctcctattatggaaggaggttgttaagctatggccgaacgcaacaattctcaccttctggatggtggtgatgattccatgggcatgacagacaaccagtataagggtatgcttctggaccagttggaagactggcaggaagtcctggatctggcaatcaaggccgggaacaccgaaatccaggaaaaggtcgagaaacagattcgcaaaatcaatgaaaagctgaagttctaaacctcgaccaaagggagagcctacggaaacgtgggctctcttcttttatatttgaaagggggcgatcggatggaaaaaatacttcgactaaacgaacaagatattgtccaggcacttgcagaccacttcaatgtggatcgcgccaaagtaaacctgacggtcaaaattaggacagagggatatggcccgaccgagcatcagtttccggaagtgagcgctgttatcaaggagggttgagcatggacattccaggaatacgatgcttgacccgcattcacatcaaagtttgctcgctgaaacccaccctgctcatgtatgaaatgatggcgaaagaaatgggcatatctctgcactgtccaaactatattgatatttcacggcttcgcccggagaaaggacaaaaagatgacgcttcatgaaaaagtagtcctatcggcttacaccggcattttgatgtgcgacttttccgaagtgcacaagtacatcgaaaaactcctcggcaggccggtctggacgcatgaactggccagcgaggctctgtggtccgaaattaaggagaaagcgaagcctgattttcacaaaatcatcgagccataggagggggtccaatgcgaaagctctatgtttgcaatcgtaagcgatgcggcgaccggtgtcactatcctgattgccggcataccactgatatttcccatgcactcaatgctccaaccttccccaacggctttgagaaggtgaagcacaacggtaacgtctattttgtagagagggaggattgatattttgacctttaaggaattcacagcctggtgcaatgaacgagcctgtgacggacggtggggtatggtagaggcaatggtctgcatcgacctgatggcggaaatccgaaaactatccttctggaaaagggaaaatttttggcgggagctgtatgaaaagcgtattttggatgaaattgtcgagccaatcaaccaaaagatcatcatcgaccaattcgccgccagaataccgcatactgaccaagcaatcacacacgaaaaggagcattctaccatgacaatcaatgaataccaggcgcttgcgctgcgcacggagtcacgcatcaccaccgaccccgtcccttatattcgcgttctggaagggcttatgggcctgaacggagaggccggcgaggccattgacctgatgaagaaagtgctgttccaaggccacgagttcgaccgggagcacatggccaaagaactgggcgacattgcctggtatctagctgtcagcgctgacgccattggctacgacctggagagcatcctgcaaatgaatgtggacaaactcaggacgcggtatccggacggtttcagcacggagcagagcctgcatcgcagcgccaatgatatttaggaggcaccgccatgagcatccaagatgactacctgtttgtccggtttgacaaatactgcaaaacctgcaagcatgagaagctggaggaaaacgaaccgccctgcgacgagtgtctggagcatccagtaaacctgcactcgcataaacccgtttgctacgagggtacggatgaatgaggaggctgcgcgctatgaaactgcgattcattggggaagatggttccatgggtctgaaaaacggcgaagcctatgacgcccgcatttatattcgagggaagttcctttgggtggaatggaaggtcgggcgtttcatgactcgttcctgcccttactcctctacgaaggcatttgcccagaattgggacctggcatacaccacttaaaacacaggagggcaatatggcacaaaagcgaatcaggatggttcagcgtgatattttgaacgatcggctgcggcttctctacgacgacggaacgcaaggtgttctggagtatggggaagccgtttcccgttccaaggcgcctgccatcatcaaaccgaacgactttgttgggctgacgctcaagcaggccaaactgaaacttggcatcaagaattgaggtgcggcccgtgagttaccaatacgatttatatttacaaaagcacaaggccaacgtgaaaaagggttttgactggcttcagaccaacatgccctggctctttgaggggaaaccggacgctgcttggcagaccgagttcgagcatgatgcgtccaaatcaaagccggatgagtacgaggcctatgacgcttatttctatggaggcaaccgctcctatgctgttgtccaggcgttccaaagagcctggctcctgcacatccaccgcaatccccatcactggcagcactgggttctaatcaacgatgaccccggtgaaggcgaagtcctgctggagatgccttacaattatattattgagatgatctgcgactggtgggccttcagctgggcggaaggtgatctgagcgagatcttctcgtggtatgatgaacataaggactatatcaaactgaacccgaagacccgcgaaaccgtggaagatattctctgggaactccggggccggcttggatttaatgtccttgctcatcatggcgtcaaaggtcagaagtggggcgttcgtaataggccgccgtatccgcttgataaaaccgggaagtctgatacaatagtgacaaaaaccatcaaaggacacactgctccttctaagcgagatgaaccggacagtgttgtcgaccatgttacttctgacggtagcgttaaaactcgtgccttttatgacggcgatggttggaaagtaaaggagatacacacaaccgatcacggaaacccaaaacaccattcatacggaagacatggggaacatgttcattattatgaatgggaccacgaaaccggcaaacagattagtaacaaacaagaagagataccacccgatctcagaaaggagaacgatgatattttatgactttggaggaatttgtaagaaatctgaccgaggagtacggcaccgccgagttcgagtataatggacaacaatgtggcgtagagccgcaaactcaggattcagagaccacttatactatgtggtatggcgaggtgtggaaagactacgacaacattgacgatcttctttcggacgggttctttgatggagaatctctccaggatattttcccgtcgatcgacgtctggttctaaatctcgcaggaaaggagaaaaactgtgataacaattcaagggcaatacaacactgctatttgctacaccaacgagctggaaggagcggctcgggagcagattcaagctgtttgtgaccggcctgagtttgcaggctgtaaaatccgcattatgcccgatgtccatgcgggtaaaggctgtaccatcggcaccaccatgaccatccaagacaaaatcgttccgggtatggtaggggtagatatcggctgcggtatggaaacggtagaactggctgagcatgagatcgactttgcaaagctggatgcactgattcgggagaagatcccctatggcagggaaattcgtgatattccccatccgctcaactcggaaatcgacttgacccagctccgttgtgccgaccagatcaatcttgaccgagcagttcacagcatcggttctttgggaggcggtaaccactttattgaggtagaccaagccggggacggacggctgttccttgtcgttcactccgggagccggcaccttgggacagaagtggccgactactaccaaaacgagggacgtcgtgcgctctggggtggagtcaagcatcaaatccaggaaaccattgatcggatgaaagctgagggccgggtcaaggagatccagatgaccatcgctattctcaagaaagagcatatactggatattccaaaggatctggcctatgtggaaggcaagctgtttgacgactatatccacgatatgaaactgacgcagcagtttgcagtgctcaaccggaaagccatggttgatgtcatcctggaggggatgggacttcacgcagtggatattttcaccaccattcacaactacatcgatacggacgccatgatcctgcgaaagggctccgtttccgccaaagctggagaaaagctgctcatcccgatcaacatgcgagatggcagcttaatttgtatcggcaagggcaatgaagagtggaactgctctgctccccatggggccggacgcctaatgagccggcgggcggcgctcaatacgctatctatggatgagttccagaaagaaatggtgggcatctattcgacttgcgttgtacccgacactttggatgaatctccgatggcttataagagcatggacgagatcgtctctcaaatcaggccaactgcggaaatcgtggagcgtatccgccccgtctacaatttcaaagcctcggactaaacctaatacgaaaaaaagaatgcctcgaattgtgtaacagcagttcggggcatttatattttccggaaaggagccgcgatgaaagcagtctatcaaagaaagcctgactgtattgcctgtatggatttgggcatggagcccgctaacttctgccccaaatgtatggagcttaatcgtgaagtggttgatattttacaactcggcgtcggtctcttcgcagacaaggccgttatcaagaaaacgaacggagcactggcaaccgttccgatgagtgaactcaccattatcgattgatattttgaaaaggagaaaacaccatgaacgaaatgaatgcaaatgcggtcgaaaccaaggaacccgagaacgctacggcgtctacccctccgaagatcattgctgtggacttcgatggctgtcttgcggtcaacaagtggccggaggtgggagagcccatctggaagaacatcaatcggctgaaagaggagcaggccaatggtaccaaggtcatcctctggaccaaccgtgtcggcgagcccctggagaaggctgtgggcttctgcaaggagcatgatattcacttggacgcagtcaacgagaacctgcctgagatcgtcgaggcctttggcggggactgccggaaggtctttgccaatgagtattgggatgaccgggcggtgctgatggacgaagaggaaaaccgctgggcctctcaggaggtcgagatggcctgtcagcgggaaaaagaggcttcggaggatacggatgactgggactatggcgtggcctgctacaagagcgctctgagggcctacgagtgcctttacagggatggtcacagcggtttcagcatccagattactaagagcattctgaaccgtctgatcgacggcaagtgcctgacgcccattgaggacactcctgatatttggagcgacatcaccagtgagtgcaactggaaagaaggatatcagcagtaccagtgcaagcgcatgtcctccctgttcaaggaagttgctccggatggcacagctacctattccgataccgaacgggtctgcggcataaacatcaatactccgaatgcggccttcagcaatggctttatgacccggctcgtggataagatcttccccatcaccatgccctatctgcctgccggcaagaagtatcgcgtgttttcggaagactttctggtcgatcctaagaacggcgactacgatacagttggctaccattatattcttacgcccgatgacaagaaggtggagcttaaccgctacttcaaggaagaggacggcaagatggtccagattgaaaaggccgaatatgaggagcggaaggcgaagcgggtgaccaagaaatgaaaaacggctgggatgatattctaaggttcatcttcaacttggtcactgttctggccatcctcggcgttctattccttgtaaaactactgtttgactttgtgaggtgggtactgtgaaaaattttgacacgatgctggtgggatttgaccacagccacggcgaccctgcggtattgatcgttgggaggaaagcacctggcgataatgttcgcatcatcaatcagttccaaggcaaagaggcggaagagctgtatcggaaactggtcggggaggaagagaaaaatgcttgaaaaaagattaggtaaaatcgactttgccgagtttggtagtatgaaggattatccgtttcaactggggcttcaacttggtttctcgatgtccggcaacggcatcatggatggtggtaaatatacggtgaatatgtctcccgactgccactgggaaatgggaactcgccacactaatcttgcggaatcccttgaccatgtggcaaaaattctcaaggatgcaaaggtaaactatgtttccgagttacttgggaagcccgtcgaagtaactttggaagatggcatatttaaggacttccgaattcttacggaggtcctttgatattttgaagggaggacacatgaaacgcatttacgtcggcacactcttgtgcattattttgtcgttgggacttttgaccggatgtgaccaaggcgtcgctcgctctctcggtggcgatatgacattagagcttgaacccgggcaaaaactggagatgattacctggaaggaggattccttgtggtatttgaccagacccatgcgggatgacgaggagccggaaacccacacgtttcagcaatcgtctgaattcggcgtgtttgaggggaccgtaaccatcatcgaatctgttgtcgaaggagaaaacgcatcatgactatttatgtttcaggaagacaatcgggcaaaaccacatttctgattcggcaatccgcagatacaggcgcggtcattgtggcgccgacctgccagatggcgagatacatcgatagtatggctcgcgaccttggtttgcagattcctccgcccgttactgtcgccgattggattcgaggcctggttcgtcagcctaaagaccatgacaaaacctacctggtggatgagctgcaaatggctctacatcaactgaatgtcaaagcggcaacgattgatagaaattatgaggagatggttcgtatgtttggagtaaaggaaacctgctgcaccagatgcagccatagggacgtgtgccagtacaagtcggagtatctggcggcacaaactgctgtggatgaggtgagcgtccgccggccctcgaaggatgacgagtctatcagcagcattcgcctccatgatattccctggatcgagccggtggagttgaaatgcacatacttccgccaggacacagggacaattcgataactactattcgggaggaataaaccaatgaacaaaaaagtgatgcgccataaggcgatctgcgacgagttgaacagcttgtacgaacggaagaaccacgactacggcgacagcttccatcagacctttgtagaggaggggctggctatgacccgtatccggctgggggacaagttctcccggtttaagaccctctcccgcctctctgcaaatgacgccggtcagcagcaggttacggacgaatccattcgggacaccctgatggatctggccaactacgccatcatgaccattctggagatggatgaggagaaagggatggaaacgcccgaccccaatgctgcctctatggcgattggtgcttgctcagcccgcagtgatattcgggccggtcttcgctgaaaccaacggaatgatgggagacagctatgcaggtcaagaaagccggaggaaaggtgtacggggccgtacttaccgcagcggagaagaaagccatggacttggagatccagcgggagctggcagagtacgaccgaaagcatatcgccgagatcgacgcgactattttatgggtgctgcatgagcaattcgggttcggggctcagcggctccgaacttattacgacgccttccacgaccgtatcaaagaattggtcagccgctatgagatggaggaccaggatgatatttggctctgcactcagatgctgaagagaatcggcgtcgatgtggaggcgtggcacaaggagagtgagcatgggacttgatgattttggaagaacagtacggaacatccgcttagtcagggcgctcctgctctatgacatggcaaaggaccttgatatttcaccggctgagctgtctgccatcgagtgcgggagaaaacctgttcccgattggttcgtctccaagctgcaagaaaaatacggcatcggcgacatgcacgctcaatcgcttatcaaatttatgaaagaacggggtgacagtgattgtcctggaacgaccgaaaaaacgcagagggatattctgatccgaccgcctatcaggccctgaagaacatcgagaccgaggaggaacggttccacaagctgctccatatgatctttgatatttgcgctttgtcggacttcgagatcgaggggcggatcgttcttgtggataagcgttccggaaaggtttggaggtgagtggaatgggtctatcaagattggcgaagaaatgccaagcgtgtccgtacgtatccacctgcgaccataagcgaatggaggcgcttggatatttaccactgccggaagcaaatgttgaagtgaaggtagatttgtcagccacaccaacagcggaactggttgatcagttgagtcgagccgtacagattccaaaacacgcattacgtggaggtcgagtatgacacttgaacagactttggaaacggtcgccaagatacagaaggcctgggacgccttggctctatcgatatcggatgcggccgaagcatttgcaaagatgtgggaggaggtcttctccagccctgatatttggcccggacggaagtctgtcccgccgaaaaagtacggcatgtctctgctcaaaaagcgtccgtaccaggcgtttccggcttatcattaccaccccattgcccctcgaaacaggccttaccagcggcgttcctattgagaatgaggctggatatttctaatctaagatagaaaacaggctaacttagaatagaattcgtccgtacacggcttgaaaatctctgcccagatggtcaaaagctgctactattactgttagtagcaggtcattttgctggccacttttggtctgtaaaacgggccatttgcccactttgggttcggattttgcgaaaatttggaggttggatagccgtgtacggacggaaaattggtgaaaaactggccatttgcccactttttgcccacttttatttcaaaagtggccaggctgaaacccttgcgccccaagggtttgcgggttttctggccacttgcccactttttttcttaattaaatgcgaaaaaaaatattaaaaattatatataagtggaagaaaaaagtggccaactggccagcaagggcaaaatagtgagttttgaggctgtttcgagccgttttcacaagatgacgtgactgcaaagttcactcttccatttcacgatgcattgtgatatactgaatccgccacacaatcgtataaagaattattcggctacggagaacacatcttggcaacaagtgtcttctctctatactcatgcgcccgtagccgggtaacgagattgtgtggcaacaatgagagatgcgctttagttgcagagtgcgtctcttcattggggcgcactcttttattttgtccaaaggagggaaggttgatgggaagatctaacaaaccgaatcctaatattggcgggaagctcggacttgtcgccggaatcgttagtgctgtgactccagttgcgattgagtttatagaccgaatccccagaaaagacgaaacggagccctctgaagaattgatatccatgccggagctctgttccaaaaagttccctttgaaactggacgaagctaaagaacttatagagggccacggtctgaaagcgctgcctatcgaagttcgcatcagagatgcgcatgttagatacaaggattgttttgaccttcaggtcgttgcctgcaataaaaaggccaactcaaaacttaagcctggagaggttgttattatccagtatgtgactcgtgaggtaatcgatgagagtctacggatatttgaagaagctgagcggcaaaaagccaccttgaagcaagaaagagccgataggcgggccgagaaatgggagcacataaaaacccatgctggtgatactgccgtcaaagcaaaggccggcgttgagaagatcattcgtcgcgacaacaaaaagaaagagcttgacaaggaggattcttatgagtagtggaaagaaacgcagcggcggcggattgctgctggaccttatcctgaccatctgcacgggaggtctttggctgatctggattctgattcggtatctgcggaacaacagctgatggaaaacaaattgatattctgcgtttagccgaggtgcctacgggtgtctcggctgtttttgttttcgcaggaaaaaccgtcgcctttatgaggaggcgatgttatgaaaccgaacatgaaagactcgacccaactactgataacgtttaccacttcgatggcggcggcgattggatcatgcgccggagccacgatctggcaatcgtttggcaaaccaaaggtcgaggagattgccgagaagaatagcaagccaaaacggaaaataggatttagtatcgattaaagattagagccgccagccgcggctcttttctttttgcccgaattgatattttaaggctgtttttctttccgcgaaaaaaacagactcttttatggagaggagagagatatgtcgcgcatatcttgttctttctatcacttttatcggaaaggaggccgtttgatggcccgaagcgcaagactggaaagcggttttcaagaccggctcatcagcacgctgaaagcacgattccctggctgtatgatatttaagatggaccagcgccagggcattcccgacctgttgattctttacggcgagaaatgggcctcccttgaatgcaagagatctaacaaagccaagagacagccgaaccaggaatattacgttgggaagatgaacgagatgtcgttctccagattcatctccccggagaacaaggaggaagtgttggatgaactttgtaaagcattccaaccttgagggtccacatgcttttcttggcgcgagcacctatcactggatcaactacacggaagagaaggtggccgacgcctacgccaagtatcgtgcggcccagcgcggcacagtccttcactcttttgccgcccagtgcatcaagctgggtcagcggctacccaagtcgcaaaagacattgaacatgtatgtcaacgatgcaatcggttacaagatgacgccggaacagatcctctactattccccgaactgcttcggcaccgctgacgcgatttcatttcgaggcgacatgctccggattcatgatttgaaaactggagaaagtccgacacacatggaacagctgatgatttatgcggcgctcttttgcttggagtataactacaagccgaacgagattcaaatggagcttcgtatttatcagaatgacggaatcatttgtcaccagcccacgatcgaagatattttccccatcatggaccggatcataaccttcgataaaatcatcaacagtatcaaagaggaggagtaagccatgaaccccatcgcggaagatattttgatgcactatggcgtcaagcggcgctctgggcgctacccctggggttctggtgaaaacccctatcagcatggcggcgactttctggccagagtggaagaactcgaagccatgggaaagagccaaaaagaaattgccgaagaactgaagatgtccactactgaccttcgtatgcaggttcgggtggcaaagcatgagcgacgggctctccaggcggaacgggccaagtcccttcgtgaagaaggaaagactctcgatgagattgccaaaatcatggggtacaacaacgactcctcggttcgtgcgcttctcaatgaaaacaccgccagcaacaagaacaaggcccttgctaccgccgaggcattgaagaaagagctggcagtaaaaggggctcttgatgttggcgagggcgtagagcagcagcttggcgtctcgaaaggagttcttcaggaagctctgttcattttggaaacagaaggttataaccgatatggcgttggagtccctcaggtgaacgatcccaagaagcggacaatcactccggttatttcggttcccgacatcgagcagagagacgcctaccagaacctcgacatcatcaagtcggtgggcgactatcactcttcggatggaggcgcatcctgggataagcgcgagtatccggcaagcatcgattcaagccgagtcaaggtgctctatggggatgagggcggctcgaacaaggacggagtcattgaaattcgtcgtggcgttgcagaccttgacctgggaaacgttcactatgcgcaggtacgcattcttgtggatgggacgcattacctcaagggcatggccatgtattctgatgacatgccggaggggtgtgacatcgtgtttaacacgaacaagcactccggaacgcccaagatggatgtattcaaaaagattcaggatgaccccgacaatcctttcggcgcattcatcaaggccaacggtcagagctactaccccgacccgaatggcaagtacacagacccgattaccggcgagaaaaaatctttgtcggccatcaataagctgaaggaggagggtgactgggacaagatgagtaagaacttgtcctcccagttcctatccaagcagcccatcaaactgatccagaagcagttggatttgacctatgccgatgcggccgatgaattcgccgagatttgctctctgaacaacccgactatcaagcggaagcttcttatggactttgcagatgaatgtgattctgccgtcgtccatctgaaagcggccgccctcccccggcagagcacacaggtcatcctgcctatcacagcaatgaaggaaacggaaatctatgcccccaactatcgtaacggtgagaaagttgtgctgatccgctaccctcatggtggaacctttgaaattccggagttgacggtcaacaacaagaatcagtcggccatctccgttctcggcaagaacatcagggatgcggtcggcatcaacccgaaggtggcggaacggctgtccggcgcggactttgatggcgaccaggttgttgtcattcctgttggcggaaaggtttctgtaaaatctacccccgccctggaggggttgaaaggtttcgacccgaaaacggaatactccaccgaggggaagaccggtatccggcttctctcaaaagaagccacccagatcgagatggggaagatttccaacctcatcaccgatatgaccttaaaaggggcccccaccgaggacatcacgaaagctgtcagacacagcatggtcgtcatcgatgcggcaaagcacaaactcgactacaagcgttcggagattgaaaacgacatccccacccttcgtaagcggtggcagggttacactgaccccgaaaccggcaaagagaaaggtggtgcctccaccctgctctccaggcgcaagcagaccgtcgatgttcccgagcgtcagggcagtggacgcattgaccgggagactggcgaagtcgtctataaggagtctggtcgaacctatatagaccctaagactgggaaaacagttcaggccacgacgaagatcaagttgctggagaaaaccaaggatgttcgcaccttgtcctctggcaccgttcaggaagatgcctatgccgactatgccaatcgtatgaaagcactcgccaaccaggcgagacttgagtatctggatacgccgacattggtacggaacgccagcgcagcaaaaacatatgcgcctgaagtcgcaaggctgaccagtgcactgaagactgcgcagcttaacgcccctaaggaacgtgaggcccagcgcatcgccaatgctcaggtaaaggccaaggttcaggcgaacaatgtcaccgacaaagacgaaatctctaagattcgtcgtgcagcgatcagtgacgctcgcgtttccactggtgcaagcggaaaaggaacgcgcattacgatctccgatggagaatgggaagcaatccaagctggcgcgatctctgatacaaccttgaaagagattcttcgttactctgatcccgatgtcgtccgggagcgcgcaaccccaagagcatcgacgcagctgtctgaagctcgtgtcaatcgcattaaagcgatggccaattctggaagcaccaactccgaaatcgcagatgctttgggcatttcgccttctgtcgtttccaagtatctcaatgagtaagaaaggaagtgagagcgaatggaaatgtgtatgcttactactaccgataacccctacgacccttttacacagtatgaagcgtggtatcggttcgacgaagacaacggctatcattcctgcgctttcttagcgcgcatcgcccgtacttccgatcagctctctgacaaggagaaccaggaagaaatcgagcgagcaatcaacgatatcatcaagtacgaccccctgggcatctataaaaaggtcaagaagattgtgcaatccgagcctgccgtgaccgcatgatggtaaaccgatggtagccattgggaaagaaacgttctctcatcaggagtgcgtttctttttgtcatttatgggacaaattcaacccaccggctgcggatcacggcctcgaactcattcaaagggtatagggggtccctccgaaatggcaccccctctgcatcgcgctggtctttgaaaattctccgggggatatttttgaaaaatgggttcggtttggggcggcgtttgaacaagcctgcaagacgagcactcactggcaaggactctttttatctggtcggaacctcctttttcctccagaggcattgcattacctccaatgtcatttttctccacttgccggcggatcgtttgtgcgggcttcttcaaatgccgccctgaactacccataaacacatggaaaacaaaacagaagttatggagagggggcgtcaagcgtggcaaaacccatcaagtcttccggcagtcaggcggggaaacgccgcgccgccttgacgccggagggccgcgagaaccaactgatcgacctggcggtatcccttgtggaaaagcggctgctggaagggaccgcctcctctcaggaggtcaccaccatcctgaagctggggaccacgagggcccgccttgagaatgagcggctggccaaggaggtggagctggtccaggccaagaccgaggcttataaatccggagtccggatggatgagctttacgagaaggccatggccgcgttcaagcgatacagtggacaggaggaggacgaggatgagtattaggtgctactccgagctgatccaactccctacctttatggaccgctaccagtacctccggctggatggcgttgtcggagaggagaccttcggctttgaccggtatatgaatcaggctttttacaagtcgccggagtggcggcaggtgcgtgacgcggtgatcgcccgggacctggggtgtgatttgggtgtggccggacgggagatattccgccgtcccatcattcaccacatgaaccccatcagcccaaaggacatccgggatcgggtggagatgatcctcgacccggagtacctgatcaccaccatccacgaaactcatctggccattcactacggcgatgagaacctgctgcttccggagccggtcgtacgaaggcccaacgacacctgcccctggaaaatgtagaaaagagggacgacactccgcccctcttttccggcttgctaagtcttgatcttggctttccccgtgaccgctgttgttccgctggaaatgcggactgtgacaaccttcacgcttccggcctgacttttggacttagcagctcttgcgcttaaccgtttcatgtcgtttctacctcctttcgcagggatgaatcaatcatgtggtccaggagcggcatggaacgggcgcaccttatgacaacacaacttttcgctataagcaaggaggcggcgccatggaaggtaatccgggaagggcacccaggctcgtgggagtcgtggtgaactgcctcgacctgaccatccgcaaaagccccggcaatgaggcggaggtcacggggcatctatcggtcctgaccgaagttctggtcgatatggacaagtcaacggaggacttctaccgggtgctcgccagaaacggcatcgccgggttctgtccgaagaagtacgtggcgatccgccggtaaggagagtgctatggagatcacagaaagcgtcctgacatctgtcaagaaactgctggggatcgacgaaggctacacgcactttgacgccgacattgtaatgcacatcaacagcgtgttttcgattctgacacagatgggggtcgggccggcaaacggattctccattacggggaaagacgaaggctggtccgatttcatttctggcggggccgtcctgcccctggtcaaatcctatgtcggcctgaaggtgcgcctgctgtttgacccgcccctcagctctgcggccgtcgagtctatgaaccggcagatcaacgagtttgagtggcggcttttcgttgcggcagacccagtcgaacccaccagcgggaaggaggaacttcaaagtggagcatgatgcattactgcactacggaatcaaaggaatgaagtggggcgtgcgccgttaccagaacaaagacggttcgctgacccccaaaggagaggcgcgctacgaccgtgacaagcgggagaacgcggccaagaagaaggaaaaccggattgacctctcccagcctgatccgaagcgctgggcaaaggaggacctggagcgcaccaagcgcaccgtggacgccagcgccaacctggccaaggagctgaagaagctggacgagagcaccacttccaagccgacgccaaagcggatggacctgtccaagatgagcgacaaggagatgcgggatcagattaaccgggagctactggaacggcagtataaccagctgttcgcggaagtgcccgccgctcaggtctccaagggccgcgaagcgctcaagaccacgctggaagttgccggcagcgttctggccattggcagcagcgcactgggcatcgcgttggccatcaaggaactgaagggctgaggtgagtcggtatggagctgcgccaccacggcattttaggccagaaatggggcgtgcgcaacggcccgccctatccattgagcggcggtgactatactccgtcccagcggaaggccatttccaacaaacgcaaaagcggcaacagcatctacaacaagaagcacttcgatgaggtgctgaaggttgataagaccacgctgagcacgctgtcctatgataaggaccggaccaagaacgccgatatgttctacgccacccaccatgctctggataaacaccagtacaacgccctgttcaaccggccgattccccagacggtctatgataaggatggaaaggcgatcggcacaggttcgttcatgaagtaccggatcgacaattccctcaagaccgacctgaaggtggccagcgaggattccggagccaaggtctttatggacctctataagaaggaccgggatttctacaactttgtcactgaccgggagcggatgcaggggtactttgtaaacgacaagtacaagttcaagggctaccgcgaagcagcggccgtccttgggaagatgcgggagccggactacaagccgacctccgatgcccttcagaccgtgtaccggatgttcaactacgtcatcccctatgacggtcagggcgacagccgaaagggacgcgatatgtataaccagcgcaccaagttcttccatgcgtgcaaggaggccggttatggcgcagttctggacacgaacgacgccatatacggcgggttcaaggccaagtcacccattatcgtgttcgatatggagcaggtggtcccgaaagacgtctaccgcacaaatctgacggatcagaagttttccactctggtcctggtcggccggaagctgctgggcttgtaacgggaggcgggtgcgtacatgttatccaacaccgccgtcccccgttattatggagcatttcgggacgccgttctccgaggggatattcacgtctgcaaggaagtggcgatggagatgtggcggatcgaccgcctgatcgagtcaccgggatattactacgatgaccgggcggtggaggggtggatcgagttctgcgagaacgagctgaccctaactgatggctccgacctgcatcttctggataccttcaagctctggggcgaacaggtgtttggatggtactatttcgacgaccgctctgtctatgtgccgaacccggatggacggggcggccggtatgtgacgaagcgggtcaagcagcggctgaccaagaagcagtacctcattgtgggaagaggcgcggccaagtccctctacgactcctgcatccaggcttatttctgtgtggtggacggctcgacgacccatcagattacgacagcccccaccatgaagcaggcggaggagatcgtcaaccccatcaagaccgccatcaccagagcgagaggccctgtgtttcagttcatgaccgagggttccttgcagaacaccaccggctccagagccaaccgcgtcaagctggcctctacaaagaaggggatcgagaacttcatctccggctccctggtggaggtccgtcccatgtcggtggacaagctccagggactccgctgcaaagtggccacggtggatgagtggctttcttcggcggacgcccgggaggatgtcatcggtgccattgagcagggcgcatccaagctggacgactacctgatcatcgccaccagctccgagggcacggtccgaaacggagcgggcgacaccatcaaaatggagctgatgaacattcttcagggcatcggccctccccaggagcacgtgtccatctggtggtacaagctggactccgtggaagaggtcgcctatccggacatgtggatcaaggcaaaccccaacctgggaaagaccgtgacctacgagacctaccagaaggacgttgaccgggcagaaacggcccccgccacccgcaacgatatgctggcaaagcggttcgggctgcccatggagggctacacctactacttcacctatgaggagactctcccccatcgccggcagagattttggcagatgccctgctccctgggggcggacctttcccagggcgatgacttctgctcctttaccttcctgtttcctcttcgggatggctcctttggcgtcaagacccgaaactacatcacatcgctgaccctgcacaagctgccggcggccatgcgggtgaagtatgaggacttcatggcggaggggagcctgatcgtcatggagggcaccgtcctggacatgatgcaggtctacgatgacctggacgagcacatcatcaaccggggctatgacgtgcgctgctttggctacgacccatataacgcccaggagttcatcaagcggtggacagatgaaaacggccccttcggcgtagaagtggtccgacagggttcccagacggaatctgtccctctgggcgagctgaaaaagctggccggagagcgtatgctgctctttgacgaggagctgctcaccttctccatgggaaactgcatcaccatggaggacaccaatggaaaccggaagctgctgaagaaacggtccgaccagaaaatcgacgctgtggcggccatgatggatgcgtatgtggcctataagcacaatccagaagcatttgaataaaaaaaaagggggggggtactatgaagccctatgaaaagcctctccccccgcaggagtacctgatgcactacggtgtcaagggtatgaaatggggcgtaagacgctaccagaactacgacggttcttacacccgcaagggtctggaacggtatcgcaaagcggagtcggactacgaaaccgctaagtcgaaagcagacgaaaccagggccgcctacaaatccggtcaagctacccgtcagcaggtcaaggatgccaagagcgctgttaagaccgagaagcgtaaaatggaaaacgcttatgaaaagctgaaaaccgacaaactggccgatgaaggaaagaagctttaccagagtggaaaaactatttcgggaaacacccaagcgacctatttggccgagggcgttatcattgctggaagcaccgtggtgtccagacttctcgcgaaccaactgaacaaccaggaggttgccaatattgccgcatcgaccatcgcgatcggcggaacgattgtcaatggtttactggcggcaaagacgagcagggagaacaaacggctgagagcgtactacgcccactaagcgaaggaggaaaagtatgggtccttacgacaaacctttttctccccaagaatacctgatgcactacggcgtcaagggtatgaaatggggcgtacgtcgttaccagaacaaggatggtacattgacaaaagccggaaaagaacggtatagtcagaaccagcaggacggggttgattcttttctgaagagtgtgggttccaaaaaggtttccgaattgaccggttctgtaaatgaagatctcgcaatccaggcggttacatatgtttccgcatttgccgctgttctcgccgtgaaagcggtacaaaaccgaatgctgcggaaaggccggatgaaagagctggataggctcaaccgggagaaggatattaaagactttgacgagtgcccccgcctcccccggaagatgaaagcggaagagagcgtcaaagtaaccaatccggattatcctgatttgggcaccaccatgaattgcaccttctgcacaaccgccatggcccttcgagagaagggatatgacgtgcaggcgacaaaagtcagtgatggattcttttctgatgactttttcaaagccactttcaattcccctgaggtcaaaatgggaaggaaaaagtcggggcaagccgttctcgatacgctttcgcagaccggcgacgggtcctatggcaatctgaccgtggcttggaaactcggggggaagcatagtcttttctggaagaatgagggcggcagaactcgaatctatgacggtcagagcggagaagagattactcaatctccgtcgaaaaccagatcgttcatggactttgtcaatctgaaaaccatcacatataaccgccttgataattgcgagccaaccacctatgccttggccgcggttgaacgacctaaaaagacgtaaagagggaggataaacatgaccgtaaaggaagccattgttattttcgcaaagcagttccccgataaggcggttgtcgggtattgggacaagccgaatggcatcgttcttaacacccagtctatcacagcgggactgacagcccctgcccagtatctcgtcacagacgatggacagatttatgggaccaaccccatgagaagcaacctcagtcctggagacatgaagaaactgtaatcccatggaccatgccgcagactcttaaccgggtctgcggattttttatgcccaaaattcaacacacagagcaacgacataatttcatcaagcgcggactggaggtgagagattatggaaattgcatttggttccaggctgaaacatgcctggaacgcttttttgggtaacgaaacctttgggttccgatacccgcttggcccaagctcctcctaccgtccggaccggcccattttcagccggggcaatgagcggtccatcatcacatcggtctacaaccggatcgcgctggacgcgtcctccatcgccatccagcacgcgaggctggatgaggacgggcggtttaccgaggtgatcgactcctcgctgaattcctgcttgtccctggaggcgaatctggaccagaccggacgggcctttatccaggacgtggtcatgtccatgctggacgagggctgcgtggccatcgtgcccacggacaccgatatcgacccggaaaacggctcctacaaaatcgagaagctgcgggtcggcaaggtcctggaatggtatccacagcacgtaaagctgcgggtctataacgagcagcggggtgaaaagcaggacattatcctgccaaagagcacggtggcactggtggagaacccgttcttcgcaatcatgaacgagcccaactccaccatgcagcggctgatccggaagctgaacattctggacgccatcgacgaacagagcggctccggaaagctcaatctgatcatccagctcccctacgtcatcaagacggaagcgagacgtcaacaggcggaaaaacgccgtagagatattgaggaacagttgtccggctccaagtatggcgtcgcttacaccgacggcacggagcatgtggtgcagctgaaccggcccatcgacaacaatctgatgtcccagatcgaatacctgacgagtatgctttacagccagttgggaatcacccaggggatattggacggcactgctgatgaccggacgaagctgaactacgacaaccggaccatcgaacccatcctgtccgccattgttgacgaaatgaagaggaaattcctcaccaaaactgctcggtcacagaagcagtcgatcctgttcttcagagacccgttcaggctggtgcccatcaacgacatcgccgaaattgccgacaagatgactcgcaacgagatcatgacctccaacgagatccggcagaagatcggtatgaagccgtcgaaggaccccaaggcggacgagctccggaacagtaacctaagcgccccgaaaggggagggcgaacagccaccatctgaatccgaaggaggaaatgttcaaaatggatctgaagtttgactttagtggctgggctacccgaaacgatcttgtctgcgctgatgggcgaaccattcgccacaacgcattcgagcactgcgacgggaagacggttcctcttgtttggaaccaccagcacaacgaacccaccaacatcctgggccacgccctcttggagaaccgcaaggacggcgtctatgcatactgcacgttcaacgagagtgagagcggcaaagcggccaaggagctggtgcagcacggggacattgtgtccctctccatctatgccaatgggctccggcagacgccgaacaaggacgtcatgcacggcgacatccgcgaggtcagcctggtagtggccggtgcgaatcccggcgccttcattgacttcgtggacatggctcatggggaaggcggtgagcaggagatgatcctgtccgcttacgagcctatttccctgtaccgtcccgatgagaagcccccgctgatccacaaggccgataccaaggagaagcctgatgacaagcccaacgcgggcgaagacggggacaaacctaaggatggcgataagtccaagggtaaagagaagcccgaggacgaggagaccatcgaggatgttgtcaacaccatgaacgagaagcagaagaaggtcatgtacgctctgattgctgctgccgcggagcaggtgaacgacaacgccgaggatgacgaggaagaggaccccgatgaccccgacaacaaatccgacaaatctaagggaggaaacaagaccatgaagcacaatgtgttcgacaccgaagacactcaggacaccgttctgagccactccgactgcgctgacattcttgctctggccaagagcagcagcgtgggcagccttcggactgctctgaagatctacgctgatcagaacgaactcaagcacggcatcgacaacatcgagagcctgttccccgactacaaggatctgcgccccggcgctcctgagcgggtcgctcgtgaccagggctgggtgagcgttgtcatgcgcaaggttcacaagagccccatcagccgcatccgcacccgccagacggacacccgcaaggacagtatccgggcccacggctatcagaagggcaagcgtaagcagctctccggcaacatgaacgtcatcacccggaccaccgatccccagaccgtgtaccgcaccgatgccctgcaccgggacgacatcatcgacatcaccgatttcgatgtggtggagtaccagtacgccgttatgcgggagaacatcaatgaagatgtcgctaccgccatcatggtgggcgatggccgtgagccggatgatgagatgaagatttccgaggatcacatccgctccatttggaacgacaacgacctctacaccatccactacgacgtggacatcgaggccgccaaggccgagctccagggcagcaagaccagcatgagcttcggcgagaactatatctatgctgaggcagtcatcgccgccgccctctatgcccgtgagaagtacaagggcaccggcacccccgatttcttctgcacgccccatatggtcaacgtgatgctgctggcccgggacatgaacggccgccgcatttacacctccaaggccgacctggccgccgccctgaatgtgggcgagctctacactgccgagcagtttgagggtctggtgcgcatggatgacgagggccacaagcacaagctgctgggcatcttcgtcaacctgaccgactacaccgtgggctccaccaagggcggcgagatcacccggttcgaccagttcgacatcgacttcaaccagcagaagtacctgatcgagactcggctgtccggtgctctgacccgcgtctactccgccatcgctctggaggagcccgtggctgccttcacctccggcggtactggcggcgatggcggcggggccggcactccctgaggagaagattcaaaatggcgaaattttatggatcggtaggctatgctgagaccattcagaccgcgcctggcgtgcatgaggagcagatcgttgagtatccgtactacggcgatttgacccggaatgcacgccagcttcagtctggggagtcgttcaacgatgacatcaatgtcgcgaacgagatcagcatagtcgccgatccgttcgccagggagaatttccacaaaatgcggtatgtgacgttcatgggggcgaagtggaaaatttcaagggtcgaggtgggctatccgcggctgatcctgaccatcggagggctgtaccatgaataggcgttatgagctccaggcggttctggagggcattctcggctccgggaatgtgtatttccagccgccggagaacctgaaggtgcggtatgactgcatcgtctatgagcggagcgaaatcgaaactgtccacgcggacaacgccccttatcgcctgctggaccgctaccaggtgacagtcatctacaagaacccggacagcgacctccctcaccgcctcgccatgctgcccatgtgcacccatgaccgccattttacagcggacaacctgaaccacgatattttcaacctgtactattaaaggaggaaatccgaaatgagtagaatcgtatgggacaagaccggtgagcgtttttacgaaaccggtgttgatcgcgctgtcctttaccccatcagctccgccggcctttacaacaagggcgtgccctggaacggcatcaccggcatcaccgagagcccttccggcgcggagcccaacaacctctatgccgacaacatcaagtacctggtgctggtgggcgctgaggacttcggcctgaccgtcgagtgctacacctaccccgacgagtgggaggagtgcgacggctccgccgagatcgcccccggtgtggtcgccggccagcagaaccgcaaggtcttcggcctgagctaccgcaccaagctgggcaacgatgtggacggtcaggaccacggctacaagctgcacctggtctacggcggcctggcctctccctctgagcggggctatcagaccgtcaacgactcccccgagcccatcaaccccagctgggagatcaccaccactcccgtggacgttcccggctacaagcccactgcccgcctgatcatcacctccaccaaggtcgatcccgccaagctgaaggccctggaggacatcctgtacggcaccgaggatcaggacgcccgcctgcctctgcctgaggaggtcattcagctgctcaagccttccgtggctgtgaccgcctctcctgagagtgccgacgccaccctgttcggcaagaaggtgtccgaccttcagaccaatgtcgcggtgggcgcggacagcatcaccggtacgctgaagaacgtgaccggctacaccgagttcagcagcaagcccgccgagcagtccggccattacctggccctgaagttcgacgtgactccgactgacgccgtcaccaccgtggagctggtgggcggcaccaagggccccgtgaccctggacgccgacaagaatatcgtcctgctgatcaagaacaacacccagagcgtcaaggtgacctccaccaaggacggttcctccgtcaccaagacctacgcgctgaccaacctgaccctggaatcctaaccaccccaacccaaaagcggggctctcttctgatatgtaccccctttactggacacccagtagagggggtattattatgcggtacacatatgagtacaaaaggaaatgtgtagaactgtatcgagaaggaaaatggccagaaacgccggaaggtgttagcgataaatcctttcgggataaagtgagactatgggtaagagcagaggatagccgcggtccagaagcactgaaacacaaaaatttcaacaggaactggacaccagaagaacggctggaactagtatcccaagtaatgtccggaaaatcctgtgtgtcagtggcaatcgaggccggtattcaagatagactattgtatcaatgggttcaaaactataaaacaaaggggtataatggcctggtagaaatgaaaaaaggtcgtccaagtaaaggggtaccccaaatgaaaaaggaagaagcaaggccactgaatgaatccgaacgagaagaattgatccggcttcgggcagaaaacgagtatataaaggcggagaatgaagttataaaaaaagagatcgccttgagagaagagaggcacgcagcgcaactcaaggcgagaaagcagcgatcatcaaagagctgcgtgaaaaaggataccaattgaaatatctgttgaaatctatgcagatggcacggtctacctattattttgagttgagcaaggccgatcaagttgctgttcgaaaccattgcttggcagatgaaatcaaagacattttctcacagcataaaggccgctacggtgtgcgaagagtatatcaggaactgataaagcgcggccacaaggtcaatcataagcgggtacaacggcttatgcacactatggggttggcaggaaagcgcccaaaggaaaagtatcattcctacaagggcgaggtcggcaaggttgctgagaatatccttgaccgggatttcagcacgacagctcctatgcaaaaatggactaccgatgtatctcagttcggtttttcgtgggggaagtgttatctctctcctatactcgacatgaacacaaacgaaatcatttcttatgatttatctcaaagtgccaatatggaacagatccagagaatgttggccggcgcctttacgaagtttccctctgtagatggcctgatctttcactctgatcaagggtggcagtaccagcacgtgtacttcaggcaggcacttaaagatcacaaaatcattcaatccatgtcaaggaagggcaactgttacgacaattgcatcatggagaccttctttggacggatgaaaaacgagatgttctacgggcatgaaaaagagtattcctcttttgaaacatttgccaaggctgttgacggctacataaattactacaacaacgaaagaatccaagagaaaacaaaatggatgcctcctacaaaattcagagaggcatccatgtgcacctaattcaattttttatgtgtccagaattctgggtacatatcattcaccgagggctccgctttctttttatttttgaaaggagaaaactgcaatgctgaagaaaaccatgacttacgaggactacaacggtgttccccgcaccgaggacttttacttcaatctgacccccgctgaggtgacggagatggagctttccgtggatggcggtctggtggagatgatcaaccgcgtggtcgcggcccaggacggaaagcagatcatcaacgtgttcaaggacatcatcctgcgggcctatggcgaaaagtcccccgacggcaagcgtttcgtcaagaatcaggagatccgggacgccttcgcccagaccaacgcgtacagcgacctgttcatggagctggccaccgacgccaaagccgcggccgcattcgtcaacggcgtcatccagcagccgaagaaggcccccgcgcccgccccgcagaactgagtttgaacaggggggccggagatgctggaacttgtggtgcctaaatcagagcagtatgacgacgacagcggctgctttattacgaccaaggaacagacccttcgtctggagcactctctggtctccctttcaaaatgggaggcgaagtggcacaagccgtacctgtccaccaagtcgaagacggtggaggagcagatcgactacgtccgctgcatgaccctgacccagaatgttgaccccaatgtctataccgccattacaccccagctgctggcggtggtcaaggactacatcgaggactccatgacggccaccaccttctcgaaggaacagagaggccgccgggggagggaaatcgtgacggcggagatcatctactactggatgatctcccaccaaatccccttcgagtgccagaagtggcatttgaaccggctgatgacgctcatcaacgtatgcagcgccaagactggcccgcagaagaagatgagccagaaggatattttcgcacaaaaccgcgccctgaacgcggcgcgaaggaagagaggaaacacaagggggtgacgccatgtatgaagaacggatctggagattcctgaaggggaagctgctttccgactgcggagccgccggactgatgggaaacctctacgccgaaagcgggctgaaccccgtcaatctccagaacacccatgagaggaagctggggctctcggacaaggaatacacccagcaggtggatttcggactttacgccgactttgtccatgacggagcgggttacggccttgcccagtggaccttctggagccggaagcagaacctgctggcctttgccaaaagcagggagaagagcatcggcgatctggagacgcagctggagttcctgtggaaggagctgacggaaagctacgcctccctggcgcagatgctgctgagtgccagttctgtccgggccgcctccgacgcggtcctgctccagtttgaacgcccggccgaccagagtgagacggccaaagcccgccgggctgcctacgggcagaagtattacgaccaatttgcaggaaaggaggcggccgccatgagcaacagtccattggtctcctacacaaagctgtcccctaaccattccggtaggcgcaagcacgccatcgataccatctccatccactgtatggccggtgatttgacggtggagagctgcggaaacctgttcgccagcccaagccggaaggccagcagcaattacgggatcgggagcgacggccggatcggactctatgtggaagaatgcaatcgctcctggtgcacctcctccagctccaacgacaaccgggccattaccatcgaggtggcgaacaacgggggagccaaccagggatggccggtatctgacgcggcttatcggtccctgatcgccctcctggtggacatctgccggagaaacgggatcaaacggctgctctggaagggcgacaagtcgctgatcgggcaggtggataagcagaacatgaccgtccaccgctggtttgcggcaaaggcgtgcccaggggactggctttacagccgccacgggcagatcgccgatgaggtaaatgcaaaactgtctgaggaggacgaggatatggaccagacaaaattcaatgagatgttctccgccgccatgacggattatctcaaaggtcttcagaacaacaactgcggcgactggtcccaggaagcgcgggactggtgtataagcgtcgggctgtttgccggaaacagaaccgcagtggacggaaagccgaacatgatgtggccgtccgggctgacccgtgaacaggccgcccagctcttctaccggcttgcgaagatggtggggcttgcgtgatgagaaatcgtacaagccgaaccagaggcaaagctggaagaaagccggacctgtcgcagttttcaaaatggatgatcgccgacattcgtcccctgctgtgggtcgtgactgtcggcggttttttactggccttttactgtgtctacaagggatacaccggcgcgcttccgtggatcggcgctatggtggggctcccctggggcgcccatggcatggtgtgcagcttttatctgaacctgtgcaaatccgaccaccgggagggcggcatcacctttgaaacggcaaaggccgccaatttcaacaccaatgtttcacagacgccggtaggctccgtggagagcccggcaatttaaggaggagtatcgatgactgcggaaatcatttcctcgctgctgatgcttgtgggcggaatcaccatcctgaccaacatcatcgtgcaggtggtcaagagcatcacctgggacaaaattcccacaaacttggttgcgctgttcgtatcagaggcgctgacgctggccctgggaggggcctatgcctcggtaaagggcatcgacatcgcctggtacatggtggcggccgccatcgtggtggggctgatgtccgcctatgcggccatgttcggcttcgataaattcaaggaagccatcgagggctggaaacagaaaagctgatcttgaaggaggtggccgaacgtgatccatttcagacatacgggggatttctcgaagctgacccggtttatggaacgggcaaaggaggccgtccgtctcggcgatctgaacaagtatggccgggcgggggtggcggccctctcgtccgcaaccccggttgactccggagaaacggccgcctcctggtattacgagattaccaacaagaacaacaccatcaccatctcgtttcacaattcaaacattcaaaatggagtccccatcgccatccttctccaatacgggcatggcacggggaccggaggctgggtacagggaagagattacatcaaccctgcgatccagcctatttttgaccagatagcagaatacgcctggaaggaggtgactcggtcatgagcaggacgatcgacgagagaatcgttgaaatgcggtttgataaccggcagttcgagcagaacgtgcagaccagcctgtctacgctggacaaactcaagcggggactggacctggacaacgccgccaagagccttgacgggcttggggacgcggcgaagcggtgcgacatgtccgtcctcggcaagtctgtggagacggtccaggccaaattttcggcgttccaggtcgtcgccatgacgactctttccaacatcaccaattcggcggtgaacacgggaaagcggctcgtgtccgccctgacaatcgaccccattaaaacgggttttcaggagtatgagacccagatcggggcggtgcagaccatcctggccaacacccagcacgaggggaccaacctccagcaggtgaaccgggccctggatgagctgaatacctacgcggataagaccatctacaactttaccgagatgacccggaacatcggcacgttcaccgcggccggcgtcaacctgcggacctcggtggactccatcaagggtatcgctaacctggcggccatttcgggctccacctcccagcaggcatccacagccatgtaccagctctcccaggccctggccgcaggcaaggtctccctgatggactggaactctgtggtcaacgccggtatgggcggcaaggtgttccaggacgccctggtgcgcacctccgagctgctgggcaccggcgcgcagaacgccatcaatgtgtacggctccttccgggagtccctcaccaaaggcgagtggctcaccacagaggtgcttaccgagaccctgaagcagtttgccggcgcgtacagcgaggccgacctgatccagcagggattctcggaggcccaggcccgagacatcgcccaaatggcgaagacggcggaggacgctgccaccaaggtcaagacctttacccagctctgggacaccctgaaggagagcgctcagtccggctggaccaccacatgggaaatcctggttggcgactttgaggaagccaaggaagtgctgaccgaggtgtccgacgccattggcggcgtgatcagcgagacctcccaggcgagaaacgaattactcagcggcggtctcagctccggctggaagcagctgctggaccagggcatcgccgatgagggcgggttcattgaatccatccaggaggtggcccgagagagcggcgacgcctttgacaagctggtggccgactcggagagcttcagtgacgcgctgaagcaggggctgacggacggggtcgtatcctccgagaccctgacgcaggcggttcataacctgcgggagaagatgaccggcatgtcccaggaggagcgcaaggcggccggatacaccgcggagatgatcgagcagattgaagccttggacaagggacttcaaaatggttcggtctccatggaggagtttacggaaaagatcctgcgcccctccggacgggaaaacctgatccaggcggtctggaatgcggctaagggcctggtcagcgtcattacccccatcaaggacgcattccgcgaaatctttccgcccgcaaccgccgaccagctgtactctcttacggagactctccgcagcttttctgagcggctgaccctctccgatgagacggcggacaagctggggcgcaccttcaaggggcttttctcggtgctggacctggtgcggcagggcgctctggcgattttcaacgctttggcgcctctgggcagcggagccggttccctggctgacggcattctcaccataaccgcagggatcggagatttcctggtcggcatcaacgaggcggccaagcagggagagttctttggaacggtggcccagacggtcgcctcggcgctggagtttgttgtgtccgggatcgagcgactgaccggatttctcgccgacgcctttgctgccccaggcctggaatccttccaggcgcttttgggacgcatccagacccgcattgggcaggtcatcgacgcggtgagcggcctgggcggcggggtcagcgacgcggcggacactatggattccgccctggagaacagcaaattcctgcaaatgctccagaccattttcaacggcgcaaagaccctggtctctggcatcatcggcgtattcggcggccttgccggcgcactggtggagagcctgagcaacgcgaatttcagcggtgtcatcgacctgctgaacggcgtctccctgggtgctatcgccctgggcattaagaagttcctggactccttccgggaggtcacagacagcgtcggcagcatcaaggagggcgtgatcgggattctggacggcgtaaagggctgtttccaggcctggcagaatgacgtcaacgccaaggccctgctgaagatcgcggccgctgtcgcggtgctgtccgcatccattctcaccatttccctgatcgacagtgaaaagctgacggcgtccctgggggccatcacggtgctctttaccgagctgatggcggccatggcggtgttcggaaagctggacctgaatgtccgcggaacaatgaagcgctccacggcaatgatcgccctctcctcctcggtcctgattctggcctccgcgctgaaaagcattgccacgctggaaccggaacagatggcggcggggcttgcgggcatcgccggactgatggctgccctggtggcagccgcgaaggtgctgggctccggttcaagctccatcatcaagggttctgcccagatggtggtctttgccgcggcaatcaaaatactggcctcggcctgcgccgacctggcccagctggaccttgccggactggcaaagggtctgatcggcgtcggtgtgctgctggcagaggtatcgctcttcatgaacgcggccaagttcagcggaaggtcggtggtcactgcctcgggcgttctggtactggccggcgctatgaaggtgctggcctcggcctgcaaagactttgcccagatgggtgttggcgagctggtcaaggggctgagcgccatcggcgcggtcctgctggagatcacggcctttaccaagctggccggaagcgccaaggggctgatcaccaccggagccgccatgatcgagattggcgcggccatgaagatatttgcctccgctatggcggacttcggacggatgtctctggcagagatcggcaagggcttgctggctatgggcggagccctggcagaggtggccgtggccatgcgctttatgccccggaacatggtaaccatgggggcgggcctgatcgcggtgggagccgcgctgaacatcattgccgacgccatgcggtccatgggcggcatgagctgggaggctgtcgcaaagagcctggtcaccatgggcggggctctggccgagctggccgttggtctgaacttcatgaacggcacgttgggcggttccgccgccatgctggtggctgccgccgcgctggcagtgctgacgccggtgctggttacgctgggcagcatgagctgggaagccattgccaaggggctggtcacggtggccggcgcctttgccgtcatcggaacggccggcgcactgctcactccgctgctgccgacgattcttggcctgggcggcgccttcgctctgatcggcgttggtgttgccggcgttggggcaggtctgctccttgtcggaaccggcctatccgccattgcggtgggcattacggccctggcaacctcccttggagcgggcgtagccattatcgtggccggcctgacctctatcatcacgggcatcgcggcgctgatcccggccattgcggagaagctgggtgaggcggtggtggcctttgcacaggtcattacgaatggcgctcctgccattggcgaggccgtcaagacccttgtcctcaccatggtggacgttctggtggagtgtgtcccggccatcgccgagggcgctctggagctggttgccggggtgctggacgccctggtggcctatacgccccagatcgtggactccatcatgcagttcctgatcgcggtgatcgacgggctggcccgcaacatgcccaccctgatccagtcggtggtggacctgctgatgtccttcttctccggcatcgtatcggcgctgggaagcatcgacaccgacgcgctgctgaagggcatcgccggaatcggcctgctgagcggcattatggtggcgctgggcgctctggccggactgatcccctccgccatggtgggtgtgcttggtctgggcgttgtcatcgcagagctggccattgttctggcggcggtgggcgcgctggcgcagatccccggcctggagtggctcatcagcgagggtggtcagctcttgcagaccatcgggaacgccattggcggctttatcggcggcatcgtgggcggatttatgagcggggtatccggctccttcccccagatcggcatggacctggccgcctttatgaccaacatacagccctttatcgacggggcaagaggtatcgacccggccatgctggagggcgtcaaggccctcaccggggcgatcatgctgattacggcggccgatttgctggagggtctgacctcctggctcaccggcggctcgtccctttccacctttgccgaggagctggtgcccttcggcgaggccatgaagaaattctcccacagcattaccggactggacggcgacctggtcagcacggcggcaatcgctggaaagaccctggctgagatggccgcgaccctgcccaacagcggcggcatcgcgggattctttgccggagagaacgacatggggtccttcggcgaccagcttgtgggcttcggcggctccatgatgaagttcgccgcaagcatcaaggggctggacaccgacgcggttcaaaatgctgccatcgccggtaaggccatggcggagctggctgccaccctccccaacacaggaggggcggtgggcttctttgccggcaacaacgacatggacgacttcggcgaacagctcgtacccttcggagcggccatcaaagcctattccgacgcggtcaaggggcttgatgtggaggcggtcaccaattccgccattgccggacaggccatgtcggagctggcggctactttgcccaacaccggcggagccgtagccttcttcgctggcgacaacgaccttgccaccttcggcgagcagctggtgtccttcggggcgtccatcaaaagctatgcccaggaggtgactgggctggataccgacgcagtcgccagctcgacggtcgccggacagaccctggtggagctggcaaacaccttgcccaacaccgggggcctggtggccttcttcacaggcgacaacgaccttgagaccttcggggaacagctggtgcccttcggggaggcgatgaaggcctactccgacagcgtgaccgacatggacagcgcagccgtaaccgcctccgccactgcggcgaaggcccttgcggagctgcaagcctcgctgcccaatattggcggcgtggtggatttctttaccggcggcaacgacctggagaccttcgcaaacggccttctcccctttggagagggcatgaaggcctatgccgacgcggtgagcggaatggacgcaggggcggtttccgcctctattatcgccacccaggccctggcagagctccaggcatctcttccccatgtgggaggggtgatgagcttctttaccgggggcaacgatcttggcctgttcgcagaggggattctctccttcggcgaggccatgaattcctacggaaacgccgtatccggcatcgatgccggggcggtatccgcctccgctactgcggctcaggcgctgtcccggctccaggcgtccctccccaatgtaggcggcatcatggaattcttcaccggcgggaatgaccttgggaaattttccgagggcatcatccccttcggcgaagcgatgaaagcctacggcgagtcggtggccggcatcgactccagcgcggtagaggcctctgccactgccgctcaatccctggcacagctccaggcggcccttccccaggtgggcgggcttatggagttctttaccggcggcaatgaccttggggtattctcggagggcatcgtgccctttggggccgctatgaagtcctatgccgaagcggtttccggcatcaacgccgacgcggtcacggcctccgctgtggcggcccaggcgctggcacagctgcaaaccgacctgcccaatgtgggcggggtcatggcattcttcaacggaggcaacgaccttggaacctttgccgccggcatcgtacccttcggcgcggccatgaagtcctatggggatgccgtggccgacatcaacaccggagccatcaccgcctcggccactgccgcccagtctctggcgcggctgcaagaggcccttcccctggtaggcggtgtgatggaattcttcaacggaagccaggacctggccgcttttgcggcgggcatcatccccttcggcgcggccatgaaatcctacggcgacgctgtggcggatattcggccggaagcggtggaaagctccgcctccgccggaatggccctggtggagctggcaaaggcccttcccaacacgggcggcctgctgtccttctttaccggagggaccgacctggccgcctttggcgatgacctgacgctgtttggcgcggacctttccgcctatgcggaggcaatcagcaatgtgaaggcggacgtggtgacggcctcggccaacgcggcggaggctctctccaacctcgcctccggcctgccggacagcagtctgtttgacaagtggttcggcggagaccagacgctggcctcctttggcggggatatttccaagttcggcgcggccatgaaggactattacggccaaatctccggcatcgacaccgggcggatggccgacgtggtcgcacaggtatggagcctgctggagctggctgagggggccgcaggggtcaacaccagcggtctgaccggctttgccgacagcatgaagaagatgggagacgccggcatctccggctttaccagcgctttctacaactgcggcgacacggtcaacaaagccgtgtccagtatgctgtccaccgtcagcggcgccgtcctctccaacctccctgtgacaaacggggccatggagacggtggtccagtcgctggcgaacattgtggacgggaaggtcccggccatccggacatcgacatcggatatgatgcggaccatggaagcatccatcacggcccactccagaacggtgggggacgcgatgaggacggtgctctccaccgccgtatccaacatcaaccgcatgaagccggagttcgagaccgccggaaagaacgccgggcagggctttatcaacggcatcaactccaagctgggcggcgcaaggtccgccggccgaagcctgggcctggccgctctggaagcggcaaagaaggcgctggacagccactccccctcccgggaattcatccatctgggcgaaaacgtgggcgagggtctggccatcggcgtcaacaacagcatcgtccctgccgcacaggccgcctccggcatgatcgacgaggtgatcgccgtcagcgagaagggcgtcgatgcctttgaggattggatcaacgagaagcagtattacggcgagctgagcctgatggacgagctggccggatgggaaaacctccaaaagaagtacagggccggcagtgaggagcggatgaagatcgaccgggaggtctatcgggttcaaaatgaactggtttccgccacctaccaggcctccctggactggatcgaggaggagaagtattacaagcgcctgagcaccgaggaggagctggccgcctatgagcggatgcaggcccggtatctggagggcagcaaggaacggatggagttggaccggaaggtcttcaccctccgcaaccagcttgtggacgagtcctatcagaactccatggactggatcgaggaggaaaagtattacaaccgtctgagcctggccgacgagctggccgcctacaagcgggtccagagccggtacgccaagggcaccgaggagcggaagaagctggaccgggaggtctaccggctggagcaggaaatctacgaggcccagcagcagtatatcgccgacgtgcagagcgttcaggaatccgccaaccagcggcgcatccagctggaggaggcctatgccaacaaggtcaagtccatcaacgagcagctggaacgggacatcgaatccctgaaccagcagtatcaggacgcggtggagtcccggaccaagagcctgtaccagtcctacggcctctttgacgaggtcgcgaagaaggaagcggtcagcagtgaaacgctgatgcagaatctggagggtcaggtccaggagtttggcgagtggcaggatattctgggtcagctctccgccaggggcgttgactcggacctgatcgcggagcttcaggagatggggccctctgccatcgaagagatccgggcgctgaactccatgagcgacgacgagctggagaagtatgtctccctctggtccatcaagcacgcccaggcccgtgaccaggcgacctcggaactggaggggcttcgggtggagacccaggagcagatcgcgcagctccgggcggacgcggcggtggagctggaggagtaccggctgacctggcagagcgaaatggcccagctggaggaggataccagccgtcagctggcctccctccggcaggaattctcggaaaatgtgggcctgatcaagcgggacacggaagccaagatggcggaaatgaccgaggcggcccggaaaatcctgtcggaagccgggtggacggagacgggacagcaaattcccgccggcctcgcccagggcgtggcccagtccaaatccacctttatcgacgagctgaccagcatggcgctggcgggcgtggaggcggtgaagagcacgctggagatcaactctccctcccgggtcttccgggagctggggtccttcaccggccttggctttgtcagcggactggccggctatgccgaaaggtcctttgccgccggcgcagacatggcggactccgccgtggacggcctttccggcgccattgctggactccccgacctgctgagcggcgaggcggagatgcggcccaccatacgcccggtgctggacctgtctgacctcaccggggcctcgacccagatcgacagcctgttctaccccctgcggtccatccgcctggcgggacaggccagcctggcgttccaaaacgcctccggggagaaccggatgacggtcaaggtagacaacgacgacatcattgaggagcttcgcaccctgcgcagtgaaatggcagagatgacggagcgcatggagcggatgcgggtcgtgctggacaccggcactctggtcggtgagatggcgggacccatggacaacgcccttggacagagggcgacacggagaggaagggggaactgagccgtgtatcattccatcaccattggcgggaaaaacacctgggatgactggcggctggtccccgcctcccggcccgtgttcaatccgccggcccagaaggtgaagacgctggaaatccccggcggggatggggtcatcgacttgtcccaatccctgaccgggtatccggtgtaccaaaaccggacgggctctatcgagtttatcgtgatgaacgacttcaagccctggcacatggcctattccgacatcatggactatctgcacgggcagaagctgcgggcagtgctggaggacgacccggagtatttctacgaggggcggttcaccatcaacgtctggaagtcggagaaggactggtcgcgcatcaccatcgactatgacgtggggccctacaagtggtcagtcctgtcctccacggacgactggctgtgggaccccttcaactttcaaaatggcgtcatccgccccgccgtgttcaaggacatcgcggtgacggaggagatccgggcggtgaagctggcggcgctgctgttcgggcgggctccggtgtgccccgtgttccgggtgagcagctcggataagcggggggtacacatccgctttatcaaccccacgctggggctggacgagaccaagctcctccccgacggggtcatccagttcccggagtttgtgttcttcggcgacctgggcgccacgctggagctgtggtgcgacacgggaacggggtccgtctccgtggacttcagacaggggaggttgtgacccatgtatagcatttatgcagacggtgtgtgcatttacaacgacgtcttttccctggacaacatgaaggtggtcaaccccaagctgactctggaggacagcgccgccgggtctctggagatgacccttccgcccaccaacgcggcctacgacaccatcgtccgcatggtcacggatatttccgtgaaaaagaacggagaagagatctgggcgggacgggccctgtcggagagccgggacttctggaacaaccgggtgctctactgcgagggggagctggccttcttcaacgactcggtccagccgccagcggagtatgccgggaaatcggtccgggagtacctcgaccagctcatcgccatccacaacgggcaggtgggtgagaaccgccggttcgccatcggggcggtgacggtggtagatgaggccttccccacctattacaccaactacggcaagaccctggagtcactcaacgccctggcggaagcctatggcggccatctccgggtgcgcaaggcggacggggtgcggtatctggactatctgaaggactacccggacacatgcagccaggtgatccagttcgggtccaacctgctggactttgtccggaactgggactccgccgagtatgccacggccatcgtccctctggggaaccggctggacgacagtcccatcgaggcgctagacgcctatctgacggtggagagcgtgaacggcggaagcctgtacgtccaatccgacgaggcagtggcgaggcatggctggatcgcgaagacggtgaactgggacgatgtgagcgacccccaggtgctgctggagaaggccagggagtatctggcggaccttcagtttgacaacctggagctggagctttccgccctggacctgcactatctggacgtggagaccgaggcggtgaagctgctggacgagatccgggtcatctcccgcccccacgggctggaccggctcttcccggtgaccaggctggagatcccgctggacgccccggagaacacccagttcaaaatgggggattcggtacaggtgagccttaccagcgtgagcaaccagaccaacgccgccgtgctggacaagatcgaaaacctccccaaggcccacaacatcctcaaggaagcccaggagaacgccacccacatcatgaacatggccaccacgggctacatcaccatcacgagggacgagcacggctcggacaccctctatatttccaacgtccgagactacaccaaggctgacaagctctggaagtggaacatgaacggcctgggctactccaacgacggtgggaagaccttcgggctggccatcaccatggacggggccatcgtggccgactacatcacagcgggggtgctgaatggcaacgtgcttcgggtgggcgtcatccgggactacaactccaacgtgatcctggacctggacaagggcaccctgaccatgaagaagggctccatcaacatcggaaacggaaacttcaccgtggacgagcagggtaacctctacgccaggcggggcaccttcgcggggacgctggcaggagccaaggggaccttcggcggcacagtgcaggcggaggactttttggacaagtacggcaacagcatgatggacctggccaaagagaagtttaccgccggatatctggacctgtacggcctgaccgtcaccaacaagaacaccggggcggtcaccttcgccgtggggccgacgggccttatcaccatcaacggccaggtgaccatgggggcggggagcaccatcaactgggcccaggtgaataatcagaacattcaatccaacccggcgtacagcctggcgaacaacgcctataatctggcggacgacgcctactatgaggcggagctggcctacgaccgggcgaaccgggcttacaagctggccgactccatcgagatgccggggtacatcaagagcacctacatcgaccagaccacgatccgttccccggtcatcgagggcggagagttttatggcgaggaattcaacatcatcgccgggggcgatttcggaagcttcaacctctacggtcctttcgggagcagccgttaccacatgctggccatcgaatatttcgagggcaacgcccctctcattaacatttacagcccctgcggcggatacatcaccatcggccagagccgcaacgggatcgtctacttcaagggggtcgtggatttcagcgccgcagacgtccaaggtctggatttaggaacaggagcatgacacagccatgaagaaaatgttaaaaaattccgaagtgtttgagcggctccactcgctcaagccactgctgtcccggcgggatcggatcggttacatcgccgcccggaactaccgctttctctccaactccctggtggaatatgagaccatccgcctcagcctgatcgaaaagtacggagaggaagggaaggatgaacggggacagcccacctttgtcctcaaaatggagtcccccaatttcaagacgttctgtgacgagctggctcccttcaacgagatgacccatgaggtggagctgatgaccgccaagtacagcgaagcggaggggaacctgacgggggaggaaattttggccatcgactggatgctggaagattaggaggtggtccgatttggccgacatcagcagttttttgaagaagattctggaggcgatctacggtgaggaggtgcggggttccatccacgacgcccttgccgccatgaataaggagtcctccagcgccatggagtttgccgccacggccaaggactccgccaaggcctccgcggaaaaagccaagaacgaggcggacaccgccgggcagaaggcggccgaagccctggactccgccgggaaagccgcccagtctgaaaccaacgccaaagcctcggagactgcggcggaggggtacgcggacctcgccgttgacgcagcggaacgggccggaacctcggaggagaacgccaaggcctcggagcagacggctctgcaacaggccagagaggcggaggagtccaagaacgccgctgctctcagcgaggccgaagccaaggcggcagaagagcgggctaaggaggtccgcaatcaggtggagaccctgggtgcccaagccacggcagacgccgcagcggctcaggaagccaggaccgccacggaggcggcgcgggacgcggccaaggttagtgaaaccaacgcaaaggcctcggagaccaaggcggaagacgccaaagcgggcgcggaagcggcgaaggaagccgccctgtccgcccaagagagcgccgaggaggacgccctgaccgccgcccagtccaaggaggacgcagaagcggccaggacagccgcggaacaggccaaggccgacgcccttgacagcgccgcagaggccgccggaagcgcagccaaagcggagcagtacagcggcaagccgcccaagcctcaaaatggaacctggtggatctgggacgcggagacaggggcctattacgacagccacatcagctgtgagctgcaaggccccatcggcgtgggcatccaggacatccggctgaccaagggtgaccactcgccgggcaccacggatatttacacggtgcatatgacagacgggtctacctacaccatttcggtctacaacggcctgaacggtacgggcgccggcgacgtattgggtatctccttcgacctggtcatccccgccgaggggtggtcggaggggagcgtcaccattgcggacgagcggcttttggccctgggcacccacaagtatttcctcagcgcggacgaagcctgtaaggaggagttcctcgactgcaatgtgcagcccaagaacatcaccacctcgggctttctcaccctgacctgcgacacagagccggcggcggacctgacggtcaacctgatccggctggagctgtcggggaacggggccattcagtaagcaaggaggcgaagcccatggagatcgcagtgaaagcaacctatgcccatctggtcaaggatgagagtctggtacagaactccgacaagctctatattgtggagttccgctttgatcagagctgggatggttatgccaaatcggctgtctttgaagccggcggcgtacagcagccgcctgtggcgttgacggatgaccgatgcattattccggctgagtgtttgaaacgggccggaatcaatctcaaaatcggagtttccggcattaaggatggggttcagaaagacacggtatggtgtctggccagcaagatcatgtacgcgcttgaccccacacaactgatgccgcccacccacatcgatggagacgtgaaggcccagatccttgaggtcatccgggaaaatactgctacagatgcagaggttcaggaagtcctcgacaatgcattccagtcctcctggatacctcccgaaaatcctgaggctccggacaataccgccactaacgaagaggtggaggacattctcgatgatgttttcggcgaagagccgtaaacaaatatttttaaggaggacatatttatgtctaaacacactactctcgaacagatgaagcttctggctcagcgcaccaagggtgagatcagcaaggtcgaatccaagtccctggtaggcgttaaggtcaacggcgttgccctggccatcgccgacaagatggtggacattctgattgcttctggtgctaccaacggcactctgtctgttgccggcaaggatgttgcggtgacgggtctggcggccctggcctacaaggctcagatctctgaggccgatctggataccgctctgaaggctgtgctggacggcaaggcttccggcgccgatctggccactctgatcggtacggatgctggtaagagcgcccgcaccatcgccaacgaggagctggccgctcagctgatccccgagggcgcccaggaggccctggatactctgactgagattgctcagtggattcaggatcaccccaatgacgcttccgcgatgaacgccgccatcaccaagctgaacggtatcgttgccggtattggcggcgacgaggacgagtacgccaccgtaatggccgccattgaaggcaagatcaccgccgcgctgaaggacattgcctccggcgcgaccaaggtggagaagtccgaggtcaacggcaacatcaagatcaatggccaggagaccgtggtctacactcaccctgccgctgaggcggtcgaagccggcttcaagaaggtcggtaaggacaatcagggtcatgcggtcatcggcgacgatgtgaccaaggaggatatcgttgctctcggtatccccgcacaggacaccacctatcagcctgctaccagccaggcaaatggtctgatgtccaaggaggacaagatcaagctggacagcattgaggttgcgactgatgaggaagtcaatcagatgctggatgaggtctttggcgccgctgttggcgtctgataaccgcggagggggatggggtattcctgtccccctcttattttttcggaaaggagctctaacatggcagagaacaaagccacaaccttagagcagttgcgggctctggcagaaaggggaaaactcgataccctgaaccgcgtcgaccagcttttagagtcgatcattcctctgctggagggcgcacagcatagcggtactaccgttactctgccggccgagaactggagcggcagagctcagactgtaaaggacaacatccttttggctgacgaaaaatactggtatattgtgtgcgctgacgcggattgctttatggcagtcagcgagactggcgtgaaagctgacaatatcaccgttaacggtcaggtcacctttcactgcgaggtaactccaacggaaaatctgaccatttatattttgcgactggaggtcgagcagaataatgagtaatgcaaacgtcggcaaggtctttaacatgaccggcggcagcggcggaggcggtactctgaggctggagaccctgacaattaccaagccgccccaaaagaccacctacaagtccggagagtcctttgaccccacgggcatggtcgttaccgcgggctatgggtatggtctcacttcggatgtgaccggatattccgtgtctccccaagtccttacggatggagtgacggaggtggttatcgcctataccgaaggccgcatcaccaagacggcaagtgtgccggttactgtgcagaaggtgctggtatccattgccgttaccaacaacccctccaagatggtctatcactatctggaggaatttgcccctgcgggaatggtggtcactgccaaattctcggatgactctacggaggaggtttcgggatacacctatcccaagaccgctttctctactttggggagccgtccggtggagatcggttatacctatgagggcgtgaccaagaccgccagcttgaatgttacagtcaaccccattgaggtggctgtccctgttcaaaatggagtccttacctatgacgggactggcaaaactccgtcctggactgggtatgatccgtcgaagatgaccatttccggcacgaccaacggcgtgaacgctgggtcctattccgcacggtttaatctgtcgtatggatatcagttccccggcggcttggatgaggccacggttgagtggatcattgaccgggcggtcatcgcttctcttccggtgcagaacaatgtactggcggccaacggcaaaccgcaggctcccacctgggccaactacgacatcggtcagttgaccattggcggagaccgatctggaactgacgcaggcgattacaaagccacatttactcctaccgccaactacaagtggtgggacggttccattgaggccaaggaggtcaagtggaccatcaccagcgttattgtacccgttcctacgcagaagggctcgccgacctatacgggagcgccccagacaccggaatgggataactttgaccaggtgaattccaaagtgcaggtgaccgcacagaccaatgccggcacccactctgccacatttattcttctgaatggcatgtggtcggacggttctacgaccaataaaaccgttcagtggagcatcggccgagcttccatcgccaaggttcccgcccagagcggagctttgaagtatgatgggaaccccaaaactccggtgtgggacgccaattatgatccaaacaaaatgacggtatctgtagaggcgaaggtcaacgccggcacagggtacactgccgcctttacaccggattccaaccatcagtggtgggatggcacggtggacgccaagacagctacctgggctatcggcaagggcgatcaggtcgtatctgtaagtccgacaagtgtgacgctgaataccggcgcccgaagcgccaagtttaccgtgacccgaaagggcgacggcgtgatctctgccgtttccaataatgttggtgtggctacgatcggtaacatcaatcagcagaccggcgaggttacggtgaacagtgtaaataacatcaccggcacgactacaattattgttaaagtagctgcgggagccaactatctggctggggccgataagcaggtagcagtcaatgcccagttcgtgaccatctacggcgtggaatgggactggaccagcagcggccccaccaagggtaagcgcaccgacggagcggcgggctttggggaccccaacccggcggtgaacaatggctccggctcctcgccctttgacaatctgtacccctggagcggcatggtcaaggagacccgcaccggcggcgtgatggtcaaggagcccaagtattggtacaagtggaccaagagcggtaagaagctgaagcttcagatcgcagacggccctgtggaagggttccatgttgacccggtgaatatggaccgtggggacggccttggagagctggacttctcctacatcgcccggtatcactgcgcaaatggcacctacaagtcggagaccaacaaggcccagcaggtgagcatcacccggagcacggcacgaacccagatccacaacctgggggccaacatctggcagctggactttgcccagatgtggtatgtaaacatgctgtttctggtggagttcgcggattggaacggcgagcggatcggccggggctgctcggccagcaactccaaggagaacaacgggcgtacggacgctatgaagtaccacaccggtactacggcggccaatcgggatacttacggtttcacacagtaccggaacatcgagggctggtgggacaatgtgtacgactggatggacggctgctattacaatggcaacggcctgaacgtcatcaagaatcccaatcagttcagcgacagtgccaacggcgtgcttgtcggtaagccggttgctggttacccgaaggacttcgccatcccgacccaaagcgggctggagtgggcgctgtatccctctgaggctggcggcagtaccaccacgtatgtcccggatggctgggatttctacggtagtaacccgtgcctgcgccgcggcggttactatgaccagaaccagtatcgcgggccgttctgcgtgggctacgacagtgcgtcgtacgcgagctcctacatcggctgtcgcctccaggaacgcccgccgaaggcggcgtgaccattcccctggggaggagggggtttggggtgaggggaccgcagtcccttcccccaagctccggccttccacgcatttcaaaatggagcggaagggctccttttcaccttaataagaacaacatttgaaaccgctcttctttggtaagaggagagcgcggggtcgactttgcagcagacgatgtcccggataactggaatttcaacggtagtaacccgtgcctgcaccacggcggtaactataaccagaaccagaatcacgggccgttctacgtgaactacaacagtgcgtcgaacacgaactccaacatcggctgtcgccttcttgaagcagacgcaggccattgggcctgtcgggtatggctgaacctcctatcggtagtcagggttcctcaccctttctattacgcagagttgaccgcgcagcacttgctgacgatgagccgtcaggacacagcctggtacacttcgggccgggtttcgccccggaaccacccgcggcgatggaacggctgtgaggctacaaggaggatattatccctgatgaaacgagtgagagtttaccaacaaatcctttcggaagacaatctgcgcctggccatccgggaagtcaatcggggacaccggcgcaacggcgaccacagcctgaacaagaaggtcctggagatcgaggcgaatatggatgaatatgtggcggagctgcgcaggttcatcgaggacctggtgagtggagacgcgcacatgcacccgccgctgaaacggcggcgctgggaccggaacgcggacagcggaaagggcaaatggcgggacatcaacgagccgctcttgtggccggaccagtatgtccaccatgcggtgttacagcccatgatcccgcacatcatgcggagcatggacaaatactgcatcgcaagcgtgccgggacggggaaattcctacggggtcaaggccatcaagaagtggatgaagggagacgccgccggcacacggtacggcgcggaatgcgacatctaccactgctttgaggagctggacccgccgtatgttatccaggcgctgaaacggctgttcaaggaccgggagaccctctggctgtgcgacgccctgatggaatacggcgtactgatcggcgcgttcttctccgcctggttcctgcacctggtactccagccgctggacctgatgatccaccaaagggagtacggcgtcagccactacctgcggcagatggacaacttcaccatcttcgcctccagcaagcggaaattgcggaagctgatccgggatattcaggcgtggctggccgacgtgggactaaagctgaaagacaactggcaggtctttcggatcggctttaccccaagggtggagaaggccagagagcatctgcccgaggtcaaacggcgccgaagacggccgaggattccgtcggcgctgggctaccggttcgggcacggttacaccatcctccgaaagcacaacctgtttcggctcaagcaaacactgcatttatattactaccgaagggatcgaaaccgggtcatctcgtttaagcgggcctccggcctgatctcacggcttgggcagctccgaaagtgcgattgtcaacggattttggagcggtattaccagccgaagaccatgttcgatcttaagaaagtcgtccgaaaagagtgcagacggcttcagaaattatatccgccctaccaggcggcgtgaaaggagcggcaccatgaaagtacaagggatggttgaccccggcagttttaccgtggagcgcattcccggaagcggaagaagccttgtacggcttttccagaacgtgacgcctgtccagaccgaggacttcaccggatatgagtacgacgagtaccatgtggaggtggagacctgggacggcatcgcggcaaacgtgcgggagaactacgagacgttcctgagaaagggaatggacaacgagatcgaccgcagcaatcgggcactgtattccgcacaagtggatacggatgccatgaacgtggaccaggaattccgtctgactctgctggagctgggtctgacggagctggatatttaagaaaggggaaaactgctatgttgtaccgaactttgaagcgcatgatcgagagaggccagacggagggtatcgagacgaagctcgatattttctatgccgccgacaaaatcagcgagagcgagtatcaggaactgctcgggatgctgagtcccaaagcctaagctttccaaatttgcctgctttgaaggaggttggatgatggcggaagaaaagaaacccacctttgtcgaggtgggtgatcggttaacatgatcagctatatcgagtacctgaacatacctatcgctttaggtctggctattatcggcgtttttttgatcatgcagatcgttggcgaaattttggagtttaaggggaaagtcgttcccgagttcattaagatcaggaaatattttgctcggaagaagcaggaacggcagaccatgcgagaaatgtccgcgacgattcacgatgtgaagaccgtgttgaacagcgtggaatcccattacagcgaagataatatcgccaagcgtgacgcctggatgaaatgggtaaatgatagagcagtggtgtatgatcagtccattgaggttctgaaagaagaaatggataagaacaccgaaatcaccatgtctctctacattgaaagcaagcgcagctcgatcataagttttgcctcgtactgcgtttgccccgataatcctgtgaccagggagcagtttaagcgagtctttcggatctatgcggaatatgaggagatcatcaaagacaacgatcttcaaaatggagaagtagacatcgctattcacatcattcgagaagcgtacgaaaaccacttgagaaacgggtcatttgtcgaggatgtgcgtggatactgatgcgagtggatctggcctctgctcctgtatctaaagcggcagaacggtgtaaaaagaggtgtaggagagtcgattattcctcgattactcctacaccttgaccgtttttgccttggggttacgggataattggtttttgtaatattactgtaacctacctcttggataatctcattgatgctccgctgggaggcgatcagcagcttttgagcatgggccagccgtagcagtgtgacataggacttgaaggagatctgcatctcatccttgaacaaatggcgaaaataggactcatttaaattcagatggcttgccacctgagagagagtcagatgttcggtgtagtggtcgttaatatatacctgggcctcagcaatctttggactaaaattggggacatgctggacgttttccaacgaactgcgggcttgagacagggccaaaagcacctgccgcagcagaatgtccaattccatttggtagaaaggactccgcttggcatacacctgataggccctgcggatgagttcgcccagccagtcggcggccgggtcgtcggcatggatgcggttttgaaaactcagggggttatagtttagaaaacgcagatactggctgtctactgcttggctgccaggagcagagatagccgagggaaggaaaatcagaaagaggtatcggcagtcctgggttccgtcagagatggctacgtggctctcgtagttattagagatgaagatgtcacctggcttcacagggtagaccttgttcagataaacaaatttccctgttcctcccacgcacaggccgatctcgtggtagcggtgccagtgcatagggtccttatttcccatcacttgataggggaacagatggatggggaaggaggggtcaaattcatattcccagttaaaacgtttcgtggcgtgcacctcccaacgcggcgacagaatagagctcttggagttctgacggggaccaactggggaaagaaggaaaaacatatttaaaaatacaaaaattgatctataaaggaaggatttatcctagtgcttaagtactatgatagcacagacctgtaaaaattccaagaaaccagccggaattgttataaaaagtaccggaaatgggattgattctatcggaagtggattgtaacatatagacaataagagcgcagtttcattaagaaagtttgatgttattgtgctccgatattgaaaggaagtgtatggaatgaaaaagtggatcgcgttgctcctgtcctgtgttatgctcctggcgatggtagccggctgcggcggcacccctgcagagagcccgagtcagtcgggcggcgctggtgaaactgccccccaatccgcggcgccggacggtgaaaccaagacttacaaggttggcttctccaacgtctgggtgggcaacacctggggcgtacagtgcgtcaacgagttggaagcctatctgcgcaacaatgagcagatctccgagtactatatctacaatgccgataacgacgtaaacaagcagatttccgacatcgaggatctgatcgccaagggcgtggatatgttgattctccagccgatctctgccgaatccgtggcggcagtggtagaagaggcctacgacgcgggaattgtggtggtaaattgtacctcccccctgtcggatgctaccgataaatacaacgtgtctgtggtggcccgggattacgacttcggctacgtgggcgccaagtggctgtgcgaggagttgggcggcgagggcaatattgtctgcctggatggcatggccggcctgtccagtgctgtgctgcgcatgcagggtgcccaggatgcctttgccgaataccccggcatcaatgtaattgcctccgagtatgccgactgggactatgctactgccaagcctgtcatggaaaacttgctggccgcttatgatgacatcgacggcatctggtcttcgggcggtgatatgacccgtgcagccatcgaggtgtgggccgactccggtcgggactggatccccatgatgggtgaggactgcaacggctttctgaaactgtggagcgagtacaaggacgacggcctgtcctgcattgccacctccctgccaacttggctgtttgcttacggtgccgagcttggcctggagatcctgaatggtacctatgagggggagaaggacattatcgtggagattcccaccattaccaatgaccaagtggacgactatgttcgctgggatctgtctgacagcttctggtgtggcaccaaaatgaccgaggaggatattgtggctctgtacggaaacggaaacgacggctctcagggccttactggcgagggtgtagctacagatcactgatggatcactgatggctgaagagaggccggagcccacacacattaccggagtgcatgcatagccgtggaaggccggcttccggcatcactgggaaagggcgagaagggtgacctgatcgcctctttcctcacctcgtagcgggaggatgagcgtattggaacaggactatctggaattcttacatatcacaaaaaactttcccggcgttacagccctggatgacgtgtccatgtcggtacataggggagagatccacgccctggtgggtgagaacggggcgggaaagagcaccctgatgaatatactgggggggaacctccagcccaacggaggggagctccagctggatggtcatccggtaaaaatttccagccccattgacgcatacagaaagggcattggtttcgtccaccaggagtcaaacctgctggagaacctatcggtgtgtgaaaatgtgtttctggggcgggaacgggttctctccctggggcgcaccgaccggaaaggcatgtgccgggagatccgggagtgctgccagcgcttgggatatcaattggagccggaaaggccggtagcggaactaaacctggctgagcggcaaagtgtggagatcgtacgggctctgctgggcagcccccgtgtcctgattctggacgagcccacagccgctctggcggaggacgaagtggcccggctgtttcgaatcgttcgggaactgcggcaggagggggtgtctgtgctatatatttcccaccggctggacgagatcatggagctggccgaccgggtaacggtacttaaggacggcaagctggtgggcaccttggagcggggggagctggacaaagagcgcatggtcagtatgatggtgggccgcgttattgaggacatctaccccgaccgcagccaggtgcagttcggcccggaactgctgcgggtggaggggctgaccctcccgggaaagctggagcacgtgagtttttccgttcgggccggcgagattgtggggttgggcggcttggagggacagggccagcggacggcgatcagagctatttttggtgaccagcggttttcccaggggagtatctctgtggaggatacccctctgaaaagcggcggaattgccgagcgcatccgcaatggcgtggcctacgtcacccacgatcggcggggggaggggctggtgcttacccagtccatccggaagaacagcgccctggccgccttgcggcggctatgcactctcatgggcctggtaaaggaggacgaggagcgaacccaggtggccgaacagatggacagtctccagatcaaggcatcctctatggaggagttggtatcccacctatccggaggcaaccaacagaaggtgatgctggcccggtggctgatgacgaaacccagagtgctcatcatcgacgagcccaccaaaggcatcgacatcggtgcccgcatgtccatctatcagattatccaccagcttaccgaggcggggatcggcattttaatgcttaccagcgatatggtggagctgattggcctgtctgaccggaccctggtgttctatgagggtaagatcgtcaaagagctgtcccgcggcgagatcactgaggagcgggtcatgaaggccgccagcggcatgacggaggagtaggcttatgaaacaactggaaaggatccaccgcaaacttgccgccaccccccaactcagcagtgtgctgaccatctgcgggctgctgcttgtggtgttcgcctccatgtgcgtgtactcggagagctatcgttccgcctataatgtcaccaatgtactggtgcagtgtgttccgctggcgtgcgtcagcctggggcagaccctggtcatcatcagtggcggtatcgacctgtctgtgggttcgaccatcagtgtgtgtaccgccattgccgcccgcctcatgggcagcgacaacccggcgcaggtgctcctgggtgtggtagtggtgtttgcctttgccgccggcgtgggtttggtcaacggtgcgggagtcaactatctcaaggtgccgcccatgattaccacactgtgtaccagcacgattctggagggtgtggcactgtggatactgcccgtggcggggggcaaaatcaacgccgatttcgcccgggtgatctacaagaagtgggacatcatcagtatgccgctgctcattctggtggcgctatttctggtgatgcgctacctgctctatcgcacccggacgggcaccagcctgtatgctatcggccgcagcagaaccattgccgcctctatgggcatcaagaccacccgggccagcatgaaggcatacgtgctggcggccctgtgtgccgcggtgacaggactgctgctggcctcccgaatgcgggtgggggaccccacctgtggggccaactacggtatggattccatcgccgccaccgtgattggcgggacttccctggcgggcggtactggactgctatcaggcacagtggcaggagcgttcctcatcggcatgctgtccaatgtcatgaacaacctcaacgtgaaccaattttaccagtacgtgatgaagggagcccttctcatcgcggccatggtggtttactccatttcagatcggctggaggtgcgtcgccgtgcgtcataatctgctgttgaaccgctcgagggggactgcctccctccagccgctggtgttgctggccatcatcgtggtgatgaccggcgcccaggctgttctggtgcccggctccctgacggtggagcagatgctcatcatctcacgccaagcgtctgctctcggcatcatcaccctgggtcaggcggcggttattctggtggggggcatcgacctgtccgtgggtgccaccgtcatgatggtaaacatcttctgcatatcggcaatgcagggcagtgatgccaatggtccattggggctgctggtgtgcctgtttatcggacttgccattggtactgccaacgccttcggcgtgctgtttctaaagattgccccctttgtcatgaccctgtgtaccactaccatctgcgagggcatctgctacgtttacacccagggctcaccgaccggcagcgcggccccctttatacgtgccctcgggaccggccgcctgttcggcatccctttttccacgctgatctggctggctctggcggccgctatgtgggtggtgctgcgctttaccgccctgggccgcaggctgtacgccgtgggcggcagccccaaggctgcccgactcagcggcatcgccaatgtccgggtagtggccggggcctatatcttctgcgctctcatgtccgctgtggccggcctgatcctgaccgggtaccacaacattgcttccctgaccctggcaggggactactccatgaactcgctggctgcggccctgattggcggcaacgccattgagggcggtcggggcggcgtttggggtgtggtgctgggctcctttttcatgatgctgctcatggctatcctgaccatgctgggcatcagccaggtgggcaagctgatcattcagggctgcatcatattagcagtggtggctgcccagcaactgtggaaaaaggactgaaaggagcgggcaaatgcgcatcggaatcaatcaattctgttttccagccccctgcgacgtgtcggaggccctgcaccgggccaagggactgggctatgactgcatggagatctgcctgaccgccgaccggaagcccggcccggcggtggggagtgtcaccgatgccctggatatcagcggctatttcaaccggctgctgcacgagcacgcaggggaggcggagtttctccaactgcgccgcatggcagaggaggtggggattcctctatgcagcgtgggcggcatcatcagcttctccatctatcccctgacagcccgggagccggaggtcgtccaaacgtccatggatgcagtccggcggatgctggacgcagctcaggtgctgggagcggcctctgctctggtgatcccgggtgtggccactgaggatatggcatacgaggaggcctacaccaccgcccaggagagagtgtctgaactggccgactatgccccgtcggtgggactgatgatcgaaaatgtctggaataacatgctgtatagcccactggagctggcacggtttgtggatgagatggggcggaagaatgtgggcatctgcttcgacatagccaacgcccggcgcttcggctacccagagcagtggatccgtaccctgggcggacggattttggagttccattgcaaggactaccgcatgtcggtggacaacatcaacggttttaccaacctgctggacggggatgtaaactatccggcggtgatggcggctatccgggacatcggctttgacggggatctgattgtggagctgatcccgccggcccatcacctggtggagcgcaccctccgccatgcgctggagaccctgcgggagctgtgtcaaatgaatggaaggaaaggatgaaaacaggatgaaaaaatacggtgtcatgattgtgggaaccgggtgggtgtccggcgagcacatccgggcttttgaaatgacggagcgggctcaggtgacggctattgtctcccgcagccgggagaagggggaggccaaaatgcgagagtacggcctggagggccgctgtaaggtctacaccgactatcaggaaggtctaaaggaccccaatgtagacattgtggtcatctgcacgccaaacgatatgcactgtgagcagaccattctggctgccgaggcggggaaacacatcctgattgaaaagccggtggccctcacctgggaggacacgaaacgaatggatgaggcggtgcgcaaggccggagtcaagacgctggtgggctatgttctccactacaaccccttgttcgtcaccgccaagaagattcagaaggacttcatcggcgaactgaagtacgcggagaccgactatttccaccgggttatgggtgatattccctgctatcagtggacgtgcaaaaagagcgtagggggcagctccctgttggccggcggttgccacgccgtggatgccatgcggtggtttatgcaggacgaggtggtgtccgtctacgcccagtccagcaaaatgcgcacggatctcgagtttgacggtaccatctccattatcctgaaattcaagaacggtgcggttggtaaggtgggcagcagctatgacttcatcagtccctatgtgttcaatcttcacctgtgcggcaccaagggcaccctctggaatgaaaagttgtggtcgcccggccagatcacggagcagcgggattacatggaattgccggtgctcacccctaacagcggtgatgtgaagcaccaccccttccctgaagaggcagcccatttcctggactgcatcatccacgacagggagacagactgccctatgtccgatgcggtcaaaactcaggaaattgtctttgccgctgacctgtccgccgccaccggcgaggtcgtacatctgcctttaaaataataaacttcgggaataaccatacattcattctttgcagtcataaacctgtcggaatccatgggctctgacaggttttgttttgcgtttgtccccttcttagtctgaattttgctttttgggctttacccaagccgtaatccgtacgggattttggagcagtcatgactggagactgacagagagcagaatgccgccatggctgcctggcgctggcaagtggtggttgcgtgggcgtaagcgtctaaggtgggctctgctgaccggagctgcttcaggagaccacctgagtctgttcgcaggccaagctggcccacacgaggccaactgccgttcaaaactccctgtcatgggtatgaccttgccctcagactgaggccgacgtatgggatttggggcccttgccgcacttcaagtgccccgttcagcgtttcactgcatccagttcccaccggcattattttggtgcaaagcatgcggtgttccaacagttgcgtttctttgaaaaagaagtatataatatacaaaaccgtttcaggcacgaatctacgcggcaacagggggtgggacgcgatgaccttgcgggagatcatgaaaaccaatgtcgggcccgaacgcttagaaccatcattaccccaggagacggagattcatcatctgcgtccagaggcggtggatgaaggcgtggtctatgaggttgtgaatgaactgggggataaggtgggggagctggcaggcagccaactggcctttctggtccgccgtgcggtggagctggacctgaatgaactgctcaacgccatcgaggacggcgtggtagtgctggaccgggaaggtcgaatttgctatgaaaatgaggcgtacagccgcatcattggagtacccatgcgcaagaccatcgggcgggatatgcatgtcattgagccggatgctctgctgcttcgggtgctggagagcggaaagcccgacgcccgaaagtggcactgcatcaaatcggtggggaaatatgtatctatgcgcatgtttcccgtgtggcggaacggtgtggtggccggggccttctccatcttccgggatgtgacggaactcaaccgtcttggcatggaagtggaacggatcacccaggtggccgaggaattgacgagccagttggatgtagagctctccaggtttcagatgattggacaggatcctcaatttcgcactcttttgtcccgtgctgtcaccgccgccaaaaccgacgcgacggtgcttattcggggggaaaatggtgtgggcaaggagggctttgcaaagctgattcaccaagccagtccccgaagaaataggccttttataacggtcaactgcgctgccatcccggaggcgctcattgagagcgagctgttcggctatgaggagggctcctttacaggggcaaggaaaggggggaagctgggcaagtttgagctggcccagggaggtaccctctttctggacgaggtgggggatatgcccctgataatgcagagcaagctgctgcgggtgcttcaagggggggagattgagaaagtcgggagggaagaaaacgtggcggtggatgtgcgaattgtggcggccaccaatcagcccctggaggaactgatagaacaaagacggtttcgggccgacctgtactatcgcctcaatgtggtgcccctctccataccgccgttgcgggaacggcagggcgatattctccctctggcctatcactttctggaccgctacaacgaacgatatcagaagtcggccgttatcagccgaggggccgcacaggcgctgctgtcctatgattggccgggtaatgtacggcagctccaaaactgcatcgagtcggccgtcattctgtgtggtcaggaggagatcgacccggccgacctttctctgggcacgatcgccagaccggttgaggcggcccagcccgcagagacgcggcaatatggaaccctgcgggaagagaccatccgttttgagggacagttgctgcgggcggtgctggagcagtgcggcggagacagggatgagactgcccaccggctgggcatcagccggcgcacattttaccgcaaatggtcggaaactcagctgtgacaaaaatggcacaagagacaaatttgacaccaataaaaggacagatttgacacaggcggggtagtcctgcgtatcatacgcaggactaccccgcctgttttcttaggggcccaagggaaagtggcggttggtcaggagttggcacgcaagttgcttttttgtgggtgtccaaacaaacacaagccttcacacattttatttaaaagaaaggggcaaaaacatccatgaagagcagcagctattccggatttttcaaactctctgttgaggagcgcatgaaggaggtggccgagttctgtgcactgacgccggaggagcaggccatcctgaaggaggctgattccctggacatggacaaggccgaccacatgattgagaatgtaattggccgctttacgctccccatgggcgtgggaatcaatttcgtaatcaacggcaaggattacgtcatccccatggttacggaggagccatccgtggtggcggcctgctccaatgcagccaagatggcccggcctggcggcggcttcactaccgactataccggcagtgtcatgatttcccagatccaactgctggacgtgcctgcccccttctacgccaaggggaagatcctggagaacaaggagaagatcgccgagatctgcaacgccagggaccccatgctggtgaagctgggcggcggcgtgaaggacgtggaggtccgggtgctggactccctggtgggcccaatggtggtggttcacctgctggtggacaccggggatgccatgggcgccaacgcggtgaacactatggccgaggccgtggcacccttcctggaggagctcaccggcggccgcgccgagctgcgtatcctctccaacctggcagaccaccgaatcgcccgcgcccgcgccgtcttcaagaaggacgccattggcggggaagaggttgtcgataaaatgatcgccgcctatgcctttgccgccgcagatccctaccgggcggccaccaacaacaagggcatcatgaacggcatcatccccgtggtcattgccaccggcaacgacacccgcgctatcgagtccggtgcccacgcctacgccgcccgcagcggacagtactcccccttcgcaacctgggagaagaacgccgacggcgatctggtgggctccatcgagatgccgatggccgtgggcctcgtgggcggcgccaccaaaattcaccccgccgccaaggtggcagtgaagatgctgggcgtcaagaccgccggggagctggcccagatcattgctgccgtgggcctggctcagaacatggccgccatgcgggctttggccaccgagggcattcagcggggccacatgtccctccacgcccgcaacctggccgccaccgccggcgccaccggagagctgctggagaaaattgtaaagcagatggtatctgaaaaaaatgtccggctggagtacgcccaggagctggtcaaacagtatcagaagtaaccggagggaggcacgcgtatgttagccattctggtgtccctggcgctgctgatcgttctcaccttccgtaagatcaacatcgtggtggtgggcattgccgccgccgcagtcatggccctcctatccggtcagccggtggtgaccgcagtcaccgatacctatatgacaggggccgcccaatttgtgagggacaacttcctgctcttctttttcagcgtcctgttcggaaaggtcatggaggagacaggggcggctgcctccattgccaaattcttggctgagctgttgggggagaagtttgccatcctgggcgtcattttctccggcgcagtgctggtctatggcggtgtcaccactctggtggtggtgttcagcctgtatcccattgccctctccctgttcaagaaggccaacctgccccgctatctgctgcccggcgcgattgccggcggttgctttacctttgcctgcgcaaactttcccggcacgcccaatctggtcaatgtgatccccaccacctatctggggaccaacaccatggcggcccctctggtgggcgtgatcaccggaattgctgtcatgctcatggtgtgtgtttacttcctgtgggaggcaagtcgggcccgggcccggggggactgctttgtggaggacgaggccactacccagagcctggtcaaggcggcatccatggtgcggctgcccagcccgatcatcgccatcctgcccattgtgctcatcctgatcctgctcaacgtgttcaagcagcatgtggtcgtggccatgctgggcggcatccttctgtgcgtggtgctgttctttcggaatgtccacggtgtgctggacatgttctcttactctgccgaaaattcggccatcgccatcatcaacactgcggtggtggtgggcttcggctcggttgtgcaggcctctcagggatttcagaagctgctggatttcgccaccagtctggaaaatatcccgcccctgctggccttcggcctgatgaccaccattctggccggcgcctgcggctccggctccggcggtttgggtatcgccctttccgccatggcggacaaatacatctccctgggcctggccccggagatcctgcaccgggtgggctccgccgcctccgttggcctggacagtctgccccataacggcgcggtaatcaccctgctgactatctgcggccaaagtcacaaggagagctataagtacattttcttccccacggttgtctttaccctggccggcatgtttctctccattgccctggggaccgtgctctatcccatctcataaggagttatatcatggaactaaaattgcctgaacagattgacgttatcgacatcaccatgcgggacgggcttcagaatgaggaacactatgtgcccctggaggccaaactctatctggctgacaggctgatcaaggccggctttaagcgcctggaggtgggctccatcagccatgtggcctatgtgccgcagtttaaggacgtagacgagctgctgctcaagcttcccaaggacgtggacgtggagtataccgttctggccctcacccccaaggccatcgagcgggtgggcggcctgctggatcggggggccaagatcgaccgggtgctcacaggccagattgccaccagcgaagcatacgccatgaagaacatgcgccgtacccaccagcagctctttgacgaggcagagaagaacgtgaaggccctccacgatatgggcatcaagagggtggctggcaacatcggcactgtgttcggctgcccgatccaggggaaggtatccatcgaacgggcctacgaatttgtggatcgtatgtttgatatcggctttgacgaggtagagcactccgattccgacggtatcgctacacccagggacattgcagactacttccaagtcattttggaaaagcacccagaccccgcacggcactccttccatatccatgatattcgcggcatgggcatcgccgggtactacgcagccatgctggctggtatccgcacctttgactgcaccgtgggcggcatcggcggtcaggtggcaaactttttggatggtgtgccggttaagggcgcgggggattactactttgacacctgccgcaccggcttggtatccaccgaagactttatcactatggtcaatggcatgggtatccataccggcgtggatcaggagaagctctacgctctcggccgcaatctggaaaagatgctgggccgtccgctttactcctttaccagcacggtgcgttccggtttgggagcataacagaagccaccggcggaggtctttcggtttgtatgggactgggctggagactgaagttctaagcgcagggacacccggagcgtatatggcgcggttgcccgtcggtgtccgctgctcaaaacagctcggtatagattttgagcacacgagtctcgtccagggggacgaagctgttgtccatcaggcggccttggccagtgatgacgctatgggtgaagtcccggaggtcctgcctggtgacgccatactcgtggagggaccgctttggaagaagctggttgagcagatcttccaggcggtcatatacggcttgggtgccgcagcccagaaggcgggcgagaaattcattcatcacggcaatttctccatcctggcggagctccagatagtttttcagcacaccggtgaacatggcgtagttgctctcgccgtgggccacatggtattttccacccagcggatagctcattgcgtgtaccgccgcgcagccggcggtgccgaaggcaatgccggcgaagttggatgccaccaggaaatcatccagcaggatatgcagggcctcacggccctcggacacgaggcgctggtagccatggagaatcatttcgatggctttgtatccgaacagcttggtgtagggggtagccctgggggacagggaggattccaccgcatgcaccagggcgtcaatggagctggcggcaaacacgccgaagggcagcccctccagcagttggggaatgagcaccgcgtggtcggcatacatggccgggctcaccagacccagcttggtgcccagacgggtgcgggcgatgatggagaggttggttacctcgctgcccgtgccgcaggtggtggggatgagcaccagctcccgccgcttatccagggcgggggccctgtcaaacagggtgtctaccccctcgccgctggagactgccaggatcttggcgatgtcgagcactgtgccgccgccaatggcaatgacacgggtacagcccattctggccgcgtcggccagaatggcgtctaccatcacatcggtgggttctccggcgtcgtattcctcctgatagatggtgtgaaccggaagtcccatctggccgaggtagggctcgtagatgtatttattagtcagaaccagatcccgttctcccggatgaaattcctttacaaagtccagacaggtctcaaagcggtgaagcgtggggcggattagaagttctaccatggtgtttctcaaatcctttcaagcttggtttgtctgcaaaacagatgtggtatctgttgttgtctgtatgcaaaatatatgccaaattgcacccgctcagaaattctgagcgggtgcaattttacagcaggccatattttttgagcttgtactgcaatgtccggcgggagataccaaggtattgggcggttttttcgcggtgtccgccgtgcagacggagtgccatttgaatgcggagatactcctcattgaggcattccgggccggattccggggagggaggctccagctgaagcatgcctgtgggaatctggttgattttgaccacggatgactcgctcataaccaccatgtgctctacaaggttgcgcagttcgcggatgtttcccggccatttgtagtgattcaggatttgatagacgcggcttgaaaattccttttgaagaccgtatttctgacagaagtggtctaaaaagtagtcggccaggggagtaatgtcctcccggcgctctcggagaggcggaatggtgatgggaatgacgttaagacggtaatacagattcatgcggaacgttccctccttgacacactgagcgagagccacattagaggcgcagatcagccggaaattcacggcccgcggtttgactgagcctaccggaataaccgctttggtttccagaacccgcagcagcttggcctggagagacagcggcatggagtttacctcatcaagaaggagggtgttgttggcggcggcttcaatcaggccgatctttccgccggaggcagccccggtgaacgcacccttctcatagccgaagagctccgcctccaatagggattcggggagagaggtgcagttgatagccaccatctgcttttttctgtaggggctgtgctggtggatatactgggccacgatctccttcccggttccggattctcccagaaggagcacggaagcgtcgctctgcgccgcacgtgcggcctgcctcagaacgcccaccatggcgggacttttggcaatcacctctctgcggtcgtcccaattgccgcgtattcctgtagcaatggcgttgatggccttggcgtggctgtatttctggttcatggcatcaacctggatctggcaggagatggcgtatacaatttcaccctgcgcgttgaaaataggggacacggttaccagacggcccacctgtttcccgtcggcagaaactgtaacatgaatctgcgtgacagcccgcttctcgtggtagaccttgtctacgacgctctccttgtagagtccgcttgcgatgaagtcatataccgtgtgatttaagtagtcctgacgggttcgccctgtgtattgcaggagcgtcttattgacaaacaggtatgtccctttgttatcaaagatgataattccaacatccagattatccaggatgttttccagcccgggcagattgcttgccatagcttccagccctccttatgcgttctgctcctatgcgtttcccctttaaaactatcaaatggagggcaaaaaatcaaccacaattgtagtgagttgcacaggcgcaattggaactgcacattgaaatacaaggattcctgagtgagcatttgcacaaaaattgcattgtcatgccctgaatgtgcaattccggcgggaagtcgtgaatttgcctcgagaagtggccgaaacaggggggaaaacagggggatacgggctggcatccggtttgcttcctaaggtggtcagacacgacccatgtcctgtcacacgattttagcaaggagaaggaggactgcaattgatgaaagcggcaattatgggcgctggagcaatgggaaccgtcttgggtgcctttcttaccagaaacgggttcccggtggatctaatcgactcctatccggcccaggtggatgcactcaacgaaaaaggggccggcgttgttggctgtgcagagctgactgtcccggtccgtgcactgctgccggagcagatggaaggggtctatgacctggtgtttctgatggtcaagcagaccaacaatgaggcgagccttcgggcgctgttgccccatttgggagagaacagtacggtatgtaccttgcagaacggagtgccggaattagctgtggccgagttcgtcggccggaaccgcacagtaggcggagcctgccgttggggggccacgtttgtggagcccggtatctccgagctgaccaacgccctctccgcccgcacggttctgtttgagatcggggagatcgacggacgtattaccgaccgcatccgagcggtggccaaggttttgggccatatggacaacggcaaggtggagattaccgacaacctgatgggggcccggtggctcaagctgatgctcaactgctgcatgagtggcctgtcctcggccttgggctgtacctttgagtcggtaatctccagtgaaaaggcgctggcctgcacctcctatcttgcggctgaggtggtccatgcagcgcgggccgcgggcttccagctaacggataccaacggactgaataccgcagagatcgccgactttcagacggcggaggagctggagcgctccaagggctacatctaccgcaactactatcccctgcgcaccgccaaggccagcatgctgcaggatctggagcggggcaaaaagacggagatccagatgattaacggctatgtcagcgccatgggccgcaagtacggtgttcccaccccgttcaacgacctggtagtgaagataattactgatatagaggagggccgccgtagagcggaattcggcaacctggctctgtttgtcctgccggagttgcaataagaaagagacaaaaaggaggaaaacctatgtcctacgtccgcaacgacagcctgatgtaccaaatgccggttcatttcgggccctgcgtaactccccgacagaacaaagaagggaagcgctttatctatgaccaggctacgcgactgaccaagcatactattgtctacgaaagtgatccggaggccctgtccgctgtcctgccccagcggttcgagctggctgccccctacgtcatcatcaatatgaacatgctgcgggacgtggcttggctggctggacacggatacaaccttaccggcgtctctgtgcccacccgtttccatggagaaaagggggtggtggaaggcaacctgcttctggttatgtgggaaaaccatgccgaccccattattaccggccgggagcagctcggttacagcaagatatttgcctccatcgacgacatccatacgtacgggggggtatcaaagacggagctgacctcctggggattccgctttctggagctggagtttgatgccaaccgccagccggagaatctggaggagctgaaacgggtgctgaataacccggatagtcagggcatcatgcactataagtacatcccgcgtaccggcggcggcttcactcaggcggatgcggaatatgtctgcctgaatccgaaagcagccaagctgcctgacgacgtaaagaagtatccggcggatcagctgacctatatgggcggtcaggtgcgctggcatatacccacctgggaggatatgcccacccagtaccatgtggcacaggctctgggcagtctgccagtcaagcggatcgtcggcgcggtacgttcggagggctataccctgggcgatctttatgggcagaccaccgtcatgtgaggcctgcggagaagcaaaagcaaagagaatgaaggagcgcattaccacggaaggagtgattgtatgtcccccagcgttatcagcctgatcggtatcctgttgggcatggtcatcttggttttcctggcattcaaaggctataatgtcattatcgtttctgttatcgccgcactggttgtggccgtttttgccggcaccgacattctgccgctgattacagactcctatatgaccaagttcgctgactttgcaaaaaataattttatgatctttctgcttagtgccgtctttggaaagctcatgggcgattccggagcggccgacaccatcgcctactccatgctgcgcgtggtcaaccacgttcacagccagcgaaccaagcagttggtcggcggtctgatgatcaccgccattgtagcggttctgacctatggcggcgtcagcctgtttgtcgtcatcttcaccctgatctccatcggccgcaagctctttgaggagctggacatcccctggcggcactaccttaccttccacggcatcggttcagctacctttaccatgaccatgctccccggtacggcagcgcttcagaacattattcccacgcagtatctgggcactacgccaatggcgggggccgccatcggcctgaccggcgctgctatccagattttactgtgtgttctctgggcagcctttatactcaagcgtgcccgcgcccggggtgagggcttccgcccctccggcgaagcagtcaaggccgcctaccgggatgaggatgaaaagaaagccgccgcaggagaaagccaggtcggcatacctctgctgctggccctgattcctccggttgtcctgcttctggtgctcaatgtctgcaagctgcatgcggttatcgcgctctcctgcggcattctggtatgtctgatcctgttcggcctgatcctgcgccgcctggataacctcaaggccactctggcagccggcgcggtgaattccatttccaccatcggtaccacatgtgctgtagtgggctttggaggcgtggtggctgcggtctccggctatcaactgatcctgggctctctgaccagtatcccgggcccggccattttcaagctgattattgccgtgaacgtggcggccggcctcaccggttcctcctccggcggcctttccatcgctctggaaaacatgcaggattacttcctggggctcggcttgtctcccaatgtcattcaccgcattggcgccatgtcctccggcggactggactccatgccccacgtcagcggctttgtcaataaccttcaggtgtgccgcctgaatcaccgccagtcttacccctcttatgccatggtctgtctggtcattcccatcgtcacaacctgtgcctgtgctgtactgctccaactgggtattctgcctgctgtttagtggatttagaaaaaatggatttgaacatttgcagaaaggagtctatattgttatggagctcaatctgaacggaaaagtcgtcgttgttaccggcggctccagcggtatcggggaggaaaccgccatggagtttgcccgggagggctgcgaggtgaccatcgcctcacgcagtgagaaaaagctggcggaagccgccgggcggttcgaggtcgagggctttcaggtccacacccaagtcgtggacgtatccaagccggaagatatcagcgccctgggcgagaaggtctttcagcagtttggccgtatcgacgtgtggatcaacaacgccggagggaatatcaccaagcccttcctggagctcacggtggaggactggaactttgttatcagcaccaacatgacttccgtattttggggtacccatgtggcagtcgactacatgagacggactggcggcggcgtcattctcaatacctcatcctacatggcgcttattcctgccacacagaagattgcctacgcagctaccaaggcgggcattgtgaacatgaccaagacgactgccggtgagctggcccccttgggtatccgggtcaactgtgtggtgcccggcctgattcagacgccaattgcggccgagcgtatcgctgccaaccgggaaaagctgtgtgcccagattgcgctacagcgcttcggagtcccctctgatgtatctcgtgtttacacctttctggcgtccgatgctgcggcattcatcaccggcgccgcaatcgaggtcagcggcggaaagctctgtgtccaggatatcggcgctccctggggaaagcagatctgaccgaggaaggcaaatggtaaatttgtttctttatcatctgcttgtataggacagcctccacagatgctccatttgacagatggctcttacttgtacggaagtcaaagttataaatactctatatttgaaaccagagagaagcagccgggatgtgtgtgttccggctgcttctgtcagattttaaatttattcactggctttctttgcattctggcactaccccaaaccgtgaaccctacaggattccggagctaaccgagagcggacgcccctcattccccggccgcatggcgctgggaggtggtggccgcgttggtgcaggcgcctggggggagccacgctgacaagtgcccctgcgtcccggattgcgttcctggtgtccgcccagtcaactgctttttttgatgagcggcttatggacgtttggagcgtgtagacgcttttcagacccgcatgagtggtggggctctttacaaacagaagtgcctatattatcataggggacatctggataatagggagggtttttgtggaacgtctcacttatacggcgctggaacaggggagatatgacggatacctgctgcggcaggcccctgagcgggtactccaattcggtgaaggaaactttctgcggggattcgcagaacatttcattgacgtgatgaacgagcgtacagactttcagggtaaggtagtggtggttccccccgcctctgccggaaagaccggccgcatcaacgatcaggaggggctctaccagctctgcctgcgggggcggcgcaacggggagacggtggatcagtgccggatagtgagttgtatcagccgggcggtggacgtgtttgaggagtatgacgcctttctccgcacggcccataatccgaatatgcgctttatcctctccaataccaccgaggcaggaatcgtctacgagccgtccagccggatggacgaccgcccccccgcagggttcccggccaagctcgcacggctgctgtgggaacgctaccagaccggactgccggggtacatcatttttccctgtgagctcattgcggacaacggcgggacgctgcgggactgcgtactgcgccacgcccgggactgggggctggaggcgggctttttccgctggctggaggaggagaacgccttttgcagcactttggtggaccgcattgttaccggctattccccggagcaggccggggcggtggcggaggccacaggcctggaggacaagctgctggatgtggcggagcccttcgcccagtggattattgaggctccggagtgggtgcagggggagttcccggcggagcaggccggtctgcccgtgcgctttgtggccgatcaccgcccctaccgggagcggaaggtgcgcattctcaacgggggccacactgtcctgaccccggcggccctcctctccgggcacacgctggtgcgcacctgcatggcggaccgggggctgaggaacttcctggatggggcgctgtttcaggagattatccccacactctccctcccccgggcggagtgcgaggacttcgccctggcggtggaggagcggtttgacaacccctacgtggaccaccgcctggtggacattgccctcaattccgtctccaagtggcgggcgcgggtgctgcccagcgtggaggccttccaccgccggcagggggcgctgcccctccggctggtattttcttttgcggccctctgcgccctctacagccggggagagggggaggggtgcccagtgcgggacgagccggctgtgctggatttcttcgcccggcgccaggcggacggaccggaggcgctggtcgccgcctttgccgccagggtggacttctggggccgggatctgacagagctgcccggcttcgtccccgccgcggggcgggccatggcccgcatccgggccgatggcatggccgcggcgctggaggcctgcgggaaggaggcgctgaaatgagccgctgcctgcgtattgcgccaacagacaacgtggccgtggccctggagccggtggcggcggggatccgcgtggcggtggagggggcttccgttaccacccgggaggacattccccaggggcacaagctcgcactgaccgccatccccgctggggcggatgtgatcaagtacggctatcccatcggacgggccaggacggagatccagccgggccagtgggtgcacacccacaacctggctacccggctggatggggcgggcgccccccaggctcaggtgaggggtggggccccggcccccctgcggccccgctcctttcagggctaccgccgggcggacggccgggtgggaatccgcaacgagctttggatcgtgcccaccgtgggctgcgttaacggcgtggcccggtccatggcccggcgggtggaggactatgctagggggcgggtggacggagtacacgtctggttccacccctacggctgctctcagatgggggaggatcaggagcacaccagggccatcctctgcggcctgatccgccaccccaatgccggggctgtactggtgctggggctggggtgtgagaacagcagcattgccgtgctgcaagagcggctgggccgctgggacagccagcgggtggctttcctggagtgccaggccgtggaggatgagctggccgagggggagcgtctgctgcgggagctggccgaccgggcggcagcggaccggcgggagccggtgggggccgatgagctggtggtgggactgaaatgcggcggctccgatggcctttccggcatcacggccaatcccctggcgggccgggtgaccgaccgggtgatcgccatgggcggctccgccctgctggcggaggtgccggagatgttcggggcggagggggtgctgttccggcgctgcgccgacgagggggtggcccgggccctgcccgcgctggtggaggagttcaaggactacttcacccgccacgggcaggtggtctatgagaacccctcgccgggcaacaaggcgggtgggatcaccaccctggaggagaagtccctgggctgtgtccagaaagggggaaatacacccatagtggatgtgctccactacggggaaactgtgcgccgccgggggctgacggtgctccagacaccgggcaatgacttggtgtccgccaccgggctggcagcggcgggggcccacctgatcctctttaccaccgggcggggcactcccttcggcgcgccggtgccaaccctgaagctggccaccaacaccgccctggccagccgcaaggccggctggatcgactacgacgcaggcggcctggcccagggggacgcttgggagccccacatccaggccctgctccaactggtgctggacacggcctccggcgcccccacccgtgctgaggccgcaggttatcgggagatcgccatctggaaggacggcgttactctttaaccgatgtgggagcagataaaaatccccgccgcagattctctgcggcggggatttttgcacactaaaaggaacagtgaatcatggtattgatggcctcctgataggagagctgaatgtgctcggacagcaaccggcaggcatcttccgggcggcgctctaaaatggcattcaggatatcaatatgctcccgattactgacctgataacggcttggacgccaggctgtgatgcggatgaggttgagatattccgtgaggctgcgcatgagctgggaggcatattggttgtgaagtgtgtcaaccagcttcaagtgaaattcgttgtccagttcaataagcggcgcagccgtctggcccgcgtttccggcctcgtcgtcctgatgctggagcagcagcgtgcgcatgtccaccgcccactggagatccacctggtgaaagcactgatggagaatcagaggttccagcagggagcgaatttcaaagatatcatggatgtccttgagcgtggggcggctgatttcaatcccttttcggggatgtatatgaaccagcttgtcctgagccagggcaagaaccgcctcccggacgggagtacgtccaagccccagcagcgcctggagctgcgcctcattgatgaattgtcccggggtcaaatctttttgcagaatcatcgtcttgatctggtcatacgcgacctgcgacagactatcccgccgtttatccaccactgccgccattggcatatcctcctgatactctatgtgatatatgacagacacatagaaaaatggctgtacttacaacatcgttggtgtcattataccagcatcttttccaggggtcaaggctttaaagtggggaaaaatggataatttttgtgctttatttacaaaatttaaggatgggaaatggctatcttggcaaaattatcggtttatgtcttgacggatggagggaactgtgctacattttgggctagagatatatcacaaatatattataaaacagattgaactcctgcggaaagcagggcggccggcgggcccgcgcatcgggaaacggcggactaggaaggatggaaagccatgagaccattcctggatgaggattttctgttgaccagtgatacggcgaggtatctataccatcaggtggcggaacgtctgcccatattggactaccactgccacgtgagcccgcgggagatcgcggaggaccggatcttccacaacctgacccagctctggctggagggggaccattacaaatggcggctgatgcgggccaatggtgtggacgaacggtatatcaccggcgatgccggggattatgagaagtttgaggcttgggccggcgccgtggagcaggcggtgggcaatcccctgtaccactggagccatctggagttgcggcgctacttcggttacacgggacacctgacggcggccaacgcccgccaggtgtgggagcactgcagcgccgtcatcggcgggggcctgagtgtgcgtgagatcctgcgtaaatccaatgtgacccttttgtgcaccactgatgatccggcggacaccctggaatggcaccagaggctggctgccgaccataccctggaaaccaaagtgctccccgcattccggccggacaaggcggttaacgtggaaaaggaggacttcccagactatctggcccggctctccgccgccgcaggggtggacatcaacggatgggggagcctgctggccgccctggataaccggatggacttcttcgcacagcacggctgcaaggtgtccgaccacggcttggacaacctgcggtacgccccggcccgcccggaggaactggatagcgtggtcaggcgccgcctggcgggagaaaccgtgacggaagaggaggtgcggcagtataagtgggcgctgctgacccacctggcacggggctacgccaagcgggactgggccatgcagcttcacttcgccgcccagcgggacaacaaccaccgtatgcaccgcctgctggggccggacaccggctacgacagcatcggccctggggtgaacctgccggcactggctgctttcctggacgggctggatgagacgggggagctgccccgcaccatcctctattccctggagcccagcgacaacgccgcgctggtggccctgatgggctgcttccaggggcccggtactgcggggaggctacagcacggctccgcctggtggttcaacgaccacaagccggggatggaggcccagcttaccaccttggccgcaggcggcttgctgggcaactttatcgggatgctcaccgattcccgcagcttcctgtcctacacccggcacgagtactttcgacgcatcctctgcaaccttatcggccggtgggtggaggacggcgaattccccgatgaccccgccgcattggagcggctggtggccgggatatcctatcgcaacagcatccactacttcggtttcgagcagtatcacttacggggggcagatacggtatgagtatgatcagcgtcaaagggcttcagaagagctttggcaagcacgaggtgctcaagggcatcgacatcgagatccagcccggcgaggtggtggccattgtgggcccctccggctgcggcaagtccacctttctgcgctgcctgaacctgctggaaaagcccacagggggacagatcctctaccacgatgtggatctggtcagcgccgacgccaggagcgccaacaaggtgctcctgggcatgggtatggtgttccagcagtttaacctctttccccacctgacggtgctggacaacatcatgctggcccccgccctggttaaaaagcgggataagaaggagtgcgagagccaggccatggagctgctgaagaccgtgggtctggaggataagcgggacgcctaccccaaccagctctccggcggacagcagcagcgcatcgccatcgcccgggccctcgccatgaggcccgaggtcatgctttttgacgagccaacctccgccctggatcccgagatggtgggcgaggtgctggacgtgatgaagaagctggccgccgatggtatgaccatgttggtagtgacccacgagatgggctttgcccgcgaggcggccgaccgggtgattttcatcgacggcggccgcattgtggaggacagcgagcccgaggagttcttcgcccatcccaagaacaagcgtcttcaggatttcctgagcaagatgctctgattcaaaccattcaaggaggaagcaaacatgtctcagatcaaggtggcccgctacagcggcgtcaagtacgaattcgtggacggctatgcccgtgtgccggtgctggagggggagtttgaccaggcccacttcgcccactgcgccctgcagcccggctgctccatcacaccggaggtctactccgtcaccgagcacaaccagctctttatcttcaccaagggcaagggctatgtgaccaccccccgtcaggcgtggaacatcagggagcccggcgtattcgtccctgagtttgacgcggagcgcttcaccatcacctgctctgcggacagcaagcagcccctggagtttctccacatcatcaccgagctgagcgactacgacaagacctgcctggtggagtcccgcatggtactgccccggttccgcggtatctctgagggctggacctacgacgaggatttcaaggacaacgacaccaccacctccattatgctgctggagcaccgcaacctgggccgtctgtctatgggctgcgtccgcggcaccggccccatcgagatcggacagcacatccacaacgagctggcccagtggtatttccccctgcccggctccgagttcatctacaccgccggcggcgaggaagtaaagatgaccggcggcgacctgtccttcacccccaccggcttctggcacggaagcaaggtggaggccggcaggcagtgcgactacatctggtttgaaatgtgcatcgacggttatcccggcgagatcaagtaagccaattcacattgactcaaaggcttaatttattgtaaaggggaatgtaccatggctttggttaaaatttcgaagggcgccgacatccgccacgagtataccgatggggtgtcccgggtgcctgttctggagggcgcctacaaggatgcggcagtggagcgcatctcccttcagcccggcgcggagctctcgcccgccctctattccaagacggagcacaaccaggtgtttctgatcaccgccggcaagggctacatcgccaccccccgccgcgtgttcaacatcacggaggtctctgtgtttgtgcccgactttgacaaggagcagttcaccttccactgtgcggccgatgccaaggagtgcatggagatcgtccatttcgtcaccgagctcaacgactacgacaagacctgcctgaaagaggcccacctgaccctgccccggttccggggcgtgtcccaggcgtggcactacaaggaggattttaccggcgccgacatccagcagatgatgatgatcgagcaccgcaacctgggccgcctgtccatgggcgccaacttcggcaccggccctaactacatcggccagcatatccacaacgagctggagcagtggtacatcatgctccccggagcctccttcacctacaccgctgaggatgaaaagatccacgtggagggcggcgacatcacattcaccccccacggctcccaccacggcagcgagtgcgccgaaggcgagcggttcgcctatgtgtggtttgagctgtgtgagaacgggtatcccggcgagattaagtaagccatgagggcgacctggccccttttgggctccaacggcccgtacagccgcgtcccgcttgccgcgtttttggaggcggaggtacggcttggcctggacggcgtggatttcgtgccacagacgccccacttctggtgcagccacacgggacatgagtccgccgctcccctcagggccgccttggcggaggcggggcttcctgtccgggtgctcacgccgcccccctaccgctactccctcaccgctccgccggggcggcagcgggaggccaccttggactactaccgggtatgtatcgccctggccgccgagctgggggccggacggctggtgctgggtgcggcgggggcctgctgggatatagagccggaggccctgcggcggaacgccgccggactgctttccgcgctgtgtcctcaggcggaggccgcaggtgtgcgcctgttgctggctccggtcatggggccggagaccccgcttattgcagagtctcctgtgctgggcaggctggaggagctctccgagctgctccgccgggtggacagccctgccctgggggtgtgcctggacaccaacgttatgagcacttggggcgacagcatcccccggtggttcgagcggttgggggagcacaccggcctggtgcgcctgtgcgacggaaactaccacggctggcgggcctggggcgagggtgtgctgcccatggagcgctaccgggcggagctggaggcggcgggctatgccggcccggtgtccctgctgctgccgggggagcgctatgccggccggccctcctggccggaggagcgggccctggaggtcctgagaggaggggcggaatgagaggcatcaaacgcagtcagctggtcaacatgaaccagcactaccgccgcttttccatggatttcttcctggattgccagcagcgcctgggtatcgggcagattgagctgtggtgcggcgccgcccacttctggctggatcacaccggctatgacgatgtctctgccctcagggccaagctgagggcccacggcgtgcgggtggtgtcggtcaccgcccccagcattgcctaccagtaccagtatgccgcccaggagcccgcccacctggagtactcctttcgatatttttccaacgccatccatctggccgccgagctgggggccgaccgggtggtggtgaactccggttggggctaccagggagaggacgagtccgccatgtggaaccgctgccgggatcacctgggccggctgtgtcaggtggcccagccctgtggagtgacactggtcatggagtccctccgggacgacgagagcaacctggtctgcaacctggagcgggcccgccggatgcaccgggaggtgggacaccccagcctgaagatgatggtggacaacattgccaccggcgcggcgggtgagactctcggggactggttccgggcctttggagccgagctgatccacatgcactttttggatggagatccctggctgcataacgtctggggggatggcaacaccgccctggcccagcagattcagaccatgaacgaccaccactataccggatatctggtgcaggaggtggccgacgagcactatttttccgatccctatgccgccgaccgccggaatcttcgggttctggagcggtttgtggaggacgattgacgttattttccggcagatgtctccgccggtcaataaaaatcagaaaaggaaaaggtgaatcaaatgaagctgaagaaactcgtacctgcggccctctctcttgcactggtcctctctctggccgcctgcggcagccccagtgagccctccggctccacgccccctgacaccaatcctcccgctaccggttcggctgtccccggcacggaggctcccgcggccgacgactccctccagaaggttctggacgcgggcaagctgaccatcgccgctgagggcaactgggtgccctacgtttacaacgaggatggcaccggcgagcttaccggctttgaggtggatatcgccaaggagatctgctcccgcctgggcgtggagcccgacttccagatctctagcagttgggatcctgtggaggccggcatggactccggacgctatgactgcatcatctgcggcgtgaaccccaagcccgagcgccaggagaagtacaacatgtccattgcttacgccgagaaccccttctgcctggtggtggccggtgacaacgaggagattaccagctttgccgacctggccggcaggagctgcgccaacgccctgaactccaccgccggtgatctggcccgcaaggcgggcgcggagctgtccgacgcatccctcaccgccgccatggatctgattgtctccggccgcgccgatgccaccgtcaacaatgtggccgccgtagaggagtacatgaaggagcgccccgacatgaacgtgaagattgccgctatctatgagcccgaggagggcgaggagtggatcatccagtccgcagtggccttccagaagggcgccgacaccctgaccgagaaagtcaacgagatcctgcaggagatgatcgatgacggcacctgctacgacctgaccgttcagtactttggccagtccgtggccgacagcaccagcatctatcagaagtaagctgaccccagcacttttccgccggggggccgccgcaggcggtcccccggccctatgaacactatttctaaaggaggcgggccgctgtggataatacccttcagttgctcatcgattcgttctggccgctctttaaggccggtcttaccatttcggtacctctgatgctcgtttcgtttatcctgggactggtcgtggccttcgcggtggcgctgatgcggatgtccaaatggaagcccttaaaagccatttcctggttctatgtctgggtcatccgcggtacgccgctgatcgtacaaatcttcatcatcttttttggcctggcctatgtgggcatcatccttgatcccatcccggcggccatcttggccctgactatcagccagggcgcctataactccgaggtcatccgtgcagccctgggctccatccccaagggccagaatgaggcgtgcagggctctgggtctgaacaagtggcagaccatgagccggatcatcgtcccccaggccgccctggtggccgtgccctccctgggtaactccttcatcagcctgctgaaggacacctccctggtggcgaccattaccgttcatgagatcttccagactgcccaggccatcaacgcggtcaagttccagccgctgctgctgtatatcgaggccgcctttgtctacctgattttcagcacggtcctgacccaaattcagggcatgctggagaaaaagctgggcaagcatctggtggataccagagtgtgatgagagaggcgcaaacatgttacatttgaatatgcaaggtctgcaggaccgggcggcttgggcgcaagccggtatccggctgccccgctacgatgtggctgccgtacgggcccgcacctgggaggcgccggtgtggctccactttggcgcgggcaacatcttccgggggttcctggccgcggcccagcagactcttttgaataccggcagggccgacacaggcatcctggccgccgaatcctttgactttcagatcattgaccaggtctatagcccctatgacgccctgagcctgctggtgcgcatgcgcgccgacggcagcgaggagcgggaggtgattgccagcgtggccggcggcctcaaggccgactgcgccggccctgactgggccaggctgacccgggtgttttgcagcccgactctccagatggccagcttcaccattaccgagaagggctacgccctaaccgatctggagaaaaagcccctgccggtggtggagcgggatctggccgccgggccggaggggccccgtcacaccatgtctatcacggcggctctgctgtaccgccgtttccaggccggaggcgcgcccattgccatggtgagcatggacaactgtgcccgcaacggggagaagctccgcgccggggtgctgtccatggcccgggactgggcggagcgggggctggtagagtccgctttcctggactggctggaggacgagggccgggtgagcttcccctggtccatgatcgacaaaattaccccccacccctccgagcgggtgcaggaggagctggggcgcctgggtgtggcggacatggccattgcccgcaccaacacgggcacccttatcgccccctttgtcaacgcggagatcacggagtacctggtgctggaggacgctttccccaacggacgccccgccctggaaggggcgggggtgtatctcacggaccggaccaccgtggagaaggcggaaaagatgaaggtgggcacttgcctaaaccccctgcacaccgctctggcggtgtacggctgcctgctggggtatacctccatcgccgccgaaatgggggatgcagatctcaaggccctggtggagcatattgccgccgagagtctgcccgtggtggaagatcccggtatcctcagccccagggcattcattgacgaggtgctccatgagcgattccccaatcccgccatcccggatacaccgcagcgtatcgcagccgacacctcacagaagctgcccgtccgttacggcggtaccctcaggcgctatgcacggcagtcggagcaggcattggccggactggagttcgcccccctggtgttcgccggctggtgccgctacctgctgggggtggatgacaggggaaacgccatgcctgtcagcccggaccccatgttgccccagctccaggcccacctgaagggaattgaagtgggccggcccgattccctggcaggacagctccgccccatcctgtccaatgcagccctctttggggttgatctgtatgcagcaggcctgggggagaggacagaagagatgttccgggacatgctggccggcccgggggcggtgcgggccaccctgcaccgcaattgtgcatgtaaacagccataacagaaatagaggattctgttccgcccttcagacggcagcagggcgggaagcgtaaggaggaaacagccttgaagatgacatttcgctggtatgggagccaactggatcccataccgctgcgatacatcaagcaaatccccaacatgagcggcgtggtcacctccctgatggatctgcccgccggcgcgctctggcccacggagcgcatctcagccctcaaagaggaagtcaatgccgctggcctggagatggaggtcattgagagcgtcaatgtccatgaggacatcaagctgggcctgcccggacgggacgcgtatatcgacaactaccgggagacggtgcggcggctgggccaggcgggtgtaaaggtgatctgctacaactttatgccggtttttgactggacccgcactgatctggccaagccgcggcccgacggctccacagtcctggcctatgatcaggcagtcattgaccgcatcaccgacccacaggccttcgcggatcagatccaacagggggcaggggagtttgagatggcgggctgggaaccggaacgcatggcggagctcaagcgcctgtttgcccaataccggaatgtctcccatgaggacctgttccgcaacctgaagtatttcctggaggcagtgattcccgtctgcgagcagtacgatgtgaagatggccatccaccccgacgatcccccctgggatatcttcggcctgccccgcatttacacctgccgggagaatatgcgccgcatcgtggagctggtggacagcccctataacgggctgaccttgtgctcaggctctctgggctccagcccctgtaacgacattcctgccctggtacgggagttcggcggagagggacatatccactttgcccatgtgcgcaacattaagttcaccggccccggccggtttgaggaggcggcccacctctccggcgacggaagcctggatctgtacgaaattatgaaggcctattacgatgtgggcttcgagggctacatacgccccgaccacggacgcatgatctgggacgaaaaggggcgggcgggctacggcctgtatgaccgggccctgggcgccagctatctgaacggcctgtgggaagcgattcagaagaataacattcagcgtaatggacaaaacggcgccgcggctgtgtagccggacgggaaaggatatggagtatgaatcccattttggaacagatttgccgcattggcatcatcccggttatcgccattgacgatgcgaagaaggccgtccccctagcccgctccctggtggagggagggctgcctgcggcagaggtgaccttccgcacctgtgccgccgaggaggccatgcgggcgattgcggctgaggtgcccgagatgcttctgggtgcgggtaccgttttaaaccatgaacaggtggaccgggccctggcggccggggccaaatttattgtcagtcccggcttcaaccccgataccgtgcgctatgtaaaggccaagggggggctgatcctgcccggtaccgctaccccaggcgagatggaacaggccatggcttttgggctggaggcggtcaagtttttccccgccgagcaaaacggcggtgtggccaagctcaaagccatcgccggaccctataaggctctgaaatggatgccgaccggcggtgtcagcgccaaaaatctgatggattatctgtcctttgaccaagttgtggcctgcggcggcacctggatggtgaaaaaagacctcattgaggcggagaactgggccgaaatcacccgcttgacccgggaggcggtggataccatgctgggcttcagcctggcccatgtgggcatcaactgcttggacgcccaggcgtccgagcgcacggccaggactatctgcggcctgttcggcctgcccttccgggcggggaacagctccaaccacgcggggacggcggtggagtgcaccaaggcccccggccccggcgtccacggacacatcgccatcggtaccaacagtgtggagcgggccatctatcatctggagcgccgcggggtggcgattgaccacgccacctgtaagaccgatgccaaggggcgggcaaaggcggtctacctggagggagactttgggggctttgctatccacctggtgcagaaataaggagggacgtaccatgaacaagcgcgttgtaacttttggcgagatcatgctccgtttggcccccaatggatattataggttcttccagaacgaccagttgcaggccaccttcggcggcggggaggccaatgtagccgtctctctggccaactacgggctggattccgtctatgttaccaagctgcccagccacgccatcggccaggcggcggtcaacgccctgcgcagctttggcgttgatacctcccatatcgtccggggcggagaccgggtgggcatctatttcctggagaagggggcctcccagcgggggagcgtgtgcatctacgaccgggcccactccgccatccaggaggcccagcctgccgactttgactgggacgcaatttttgccggggcggactggttccactttaccggcatcacgcccgctctgggccccaatgtggtggagatctgcaaggacgcctgccgggcagccaaggccaggggagtcaagatctcctgcgatctgaactaccggggcaagctgtggacccgggagcaggcccgggcggccatgagtgagctgtgccggtatgtggacgtgtgcatctccaatgaggaagacgccaaggacgtgttcggtattgaggctgcggagaccgacattactggcggcaagttaaataaggaaggctacaagagtgtggccaggcagttggctgaccagttcggctttgagcgggtggccatcaccctgcgcagctccatttccgccagcgacaacgactgggccggcatgctgtacgatggggaacactactgcttctccaaggagtatcacctgcgcatcgtggaccgggtgggcggcggagacagctttggcggcggattgatttacgccctgctggctggaaaggacagccaggcggccattgaatttgccgtagcggcctccgccctcaaacactcaattgagggagattttaaccgcatcaccgtggcggaggtcgaaaagctggccggtggagacggctccggccgggtacagcgctgataccggtcatggggagcgcagacggaatgggactgctcacaaaatagcggagaaataccgctgggtcgatgctcaacaccgtacggcggaacgattcagaccggcgcagcgtttgaaaaggcactgtatttcgtagaaatacagtgccttttctctgcgttcccgaccatttgttttgtgccttcaagtctcgggcagatgcattgagaggcagaaatattgctgcaaataccgtgagaaagcacagccaagcctcgtttttgaaatgagaagcataatattgcgatgtcctatcggcaacaatttataccacgctttggacgacagagcgtggggctacctctaagatgcacaatctaatgatggatttccctatagtattgttgtataataaataaaaattcagggataaggatggagcgctatggaggagtatcgtattacaattgcagggcaaagcaaatatgaaattgaactctgtgccgtccagtgtggcagggattatagtgtcacaatctgcggtgggggccgtcatcatgtgggagctgcggcgctggggtgcgacgaatccggaacagtgggacacaaaatgcgcggcgctaccgtcagtgtgctgtgtgtgttcggacacagagacgacgaggcggcacggtgggcggcaaagtatctggctaccgagctgaaatgcaatgtcagtgtagcggtcggcatccacattgaccacgcggatggcagtgagatccaatgccttctggagaattgcagggaggcatgcagacaattcaaagaccgtgtgcgggcggacaggctgtcttaaagcgggtgaaagtggtggtagagtacggaggagaaccgttcagccgaatccaaatgagggtgacaggggggaggcatcagcctcccccctctaagcagggaatggtttgggctgcccctgccgcaagcccatctctcctggggtacatccctgcatctttatgacatgattctctcacagttttattttccacggttgtggcgctttggcaggttgtactttttgatcttgcgaaccagagtcgacagatcaatgccgagagtggcggcaatctcgctgagggtacggtcctcctgaagacgctgggccaatactgcggcctcaacctcctccaaaatgcagtgcaggctggagcccgccggtaccggcccctggggcgtacgctgtagccactgggcggtcatctcgtcgggcagatcctccagctcgagggtgtcgctccttgccagtacaaaggcccgctcgatgatgttgttcagctcccggatattgcctggccagcggtaggccagaagggccttcttgaaggcctggccaaacagcttcgcggttccctgctggcggttcaggcgcagcaggatgtgctcggccaggggcaggatatcctccgtccgctcccgcaggggcggaatgtgcacgggaatgacgttgagtcggtaatagagatcccggcggaaggagccctgggcaacctcttttttcagatcccggttggtggcggccacgacgcgggcgttcataggcaggggagcggtgccgccgatgcggtagaaccggcggtcctggagcacggtcagcagcttgacctggagctggggcggcagttcgccgatttcgtccaaaaagatcacaccgtctcccgccagctcaaagattccccgctttcccgtccggttggccccggtaaaggcgcctgcctcatagccgaacagctctgattccagcaggttctccggaaggttcccacaggagatcttgatatagtccgggctgcccgcaaagcggcagatcatgcggcaaaagacatccttaccaacgccggattcgccggtaatcaggacggtggagcggacgtggctgacccgcagggccagctccgccaggttgtgcatggccttactcctgcctacgatgtcgtagtcctccatcaggtggagcatctcattgatgcgctgaaccagctcccggttggccttctctttgacctgcatctcccggtcgtagtccaaataggtgatgtccatctgctggcggagctgcatcagctcggtcatgtcccgcacgttgcccaccgcgccgcggaatcgtccgtccgggctgtagacaggggagagggtgacgaggagaagccgctcggagtcggcctggtacttgatgagttcggagcgggtttcccggctctggaacacctccagcatcatccgcgagatgggaaacccctccttgacaagctggtggatgttgtgcccctggatcttttcatccggaagcccggtcatttcactgtaagcccggttgttgtagacaatatatccggtttcgtccgtataggtgaagccgtcggtggccgagtccatgatagccgccaggatctccggatccattaggcgtttgatattagcgccggacatggggcggaagcctcctctcttggccctacagcgcccccagcagccgccaccaggggagatagagcagaaatacggcgaaaagcataagagcggtatggggaatgccaacccggagcagctcatgggtggaatagcagcggtcgccttcacccagcagcagaattacatggtggaagggcagaagaaattggctgcacaccgcaatgcagatgagaaacatcagcggaagaggaggggccaccccggcaccgatggacatcagcccgggtactaccaccgacatggtggtgatgttgctgcccagcacggtgtggagcagtaccacggtcagcagaaccaccgctgcgtaagccggcgagaatgtctgtggaaaaacaggaacaaaaagggaaaacagccggtcggccacaccgcaggactttaaggttccaccgatggcaaaggccgctgtgaggaaaatcagcagcttgacgttgatggcctttacgtccggcaggcgcagcagccccagggggaacatgagcgccgtggcggctgccacaaccagagtgccggtaagggggtgaaaatcctcggtggcccaaagcaccaccacggccagcagaaagaccaggttgcgccgttccgacccagtgagctgaacccgctccgccgtctgtgccgggctggaggggaaggtgcgcagcaccctgcggaacaggaaccggtagagaaggaccgccgccagcaggtaggccagggtgggagccagcatataggccgcccagacgccctcatctacggtcaggccggccatggaggagagggcgccattgagaataatatcgccccgaatcatggacatatttatcaaaatagagaaataataaaggccgaacaggagggcggtgcgcaaaggctcggacaggtttattctagcaaagtactcccggtagatcaacgaaaggataatgatgcgggaaaagggctggggaatgagaaacatcatggccgcggcggagaggaggagggagagcaccatacgcccgggggagcgggcaaagtgcgccagaagaggctggagcagcttgcccggcaggccgctgttggaaattccttgggaaaacagaaaagagacggtgatgaggacaaaattttctgacagggggaaggaaaagactgtctggatcggcgcgccgctgcacagcaaaaaggccgccagcaaaaagagagaggccgctgtccgctccaccaccccggtcacccaccacaggatggtgagcaccagggcggcgaggatgacggactgctgtagggtaaagccgagggggcgcagcagaagaatcagggcggggagcaccagtgtgagcacaaaaagaagggcgcgccgacggtttgcggccagcggcgccttgacccgggtttccataaacgtccccctcacagtgtcagccccatggggcccgcctgaaagatgcggtggtccatctcacgcagctccggggaaatcaggggcctgaactccatctgggccagaatatcctgctccagctccacgccgggggcgatttcggtgagcatcagcccatccggcgtcagcttgagcaccgcccgctccgtaaggaaggtcacatcctggccgcttttgactgcgtaatcgccggaaaaggtgatctgctccacttgacggcggaattttttgctcctgccctcttgcagtataaccaacctgccgtcccgcacctcctcctttaggccgcctgcggtaaaggttccggtaaaaaacacgcgtttggtattttgggagatgttgacaaagcctccggggccggtgcagcgggagccgaacttggagacatttacgttgccgtggcagtcaacctccgccgcgcccaggaaggacagatccagcatgccgccgtcataaagctcaagagtatcggccacggtatagatggcctcggcgttgaccgctgaaccgaatccagccccctccaccggcacgccgccctggggaccggactccagggagagggtgatgcgctgggcgatgccctcctcgttggccaccactccaaccccggagggaatgccgatgcccagattgatgagacagtcgggccgcagctccagggctccccggcgggcgatgagtttacggttgtccaggggcatgggcgggatggagtcggtggggcggcggagctgcccgctgagctccggacggagctgggccgcgtagctctgcatatgcagggccgggtcggtattgaccaccacatagtccaccatcgggtggtgaacccgtacgctcttgggcggcagagagccacggctgacgatcccccgcacctgggcaataacaatgccgccgctgttgtgggtggcggcggccagttcggcggcatagtcgcccacgccttcatcctccatggacaggctgccgtcctcgtcggcccaggtggcccggatgaagcaggcgtcgatggggaaggtcttgtaggccagataatcccgcccgtccagcgaaactaactccacgatgtcccggccctgagcccgggttttttgattcgccttgcagccctccacccggggatcggcaaaggtgcccagccccacatgggtgagcaccgcgggcttgtggccggcgatcgcccgccacaggtggagcatcacgccaaggggcagggcataggccgccacctggttggtgccgatgagctcggcgatctcgggcgggttggcaaagtgcccggccatcacggtatccagcaggccaggagcccggagccgggccaggccgcggccgtcgggccggttgctgccgggactgatgccgcataccgccgtcagggctctggggcttcccaggcgctcataccgttccgctagggcggatagaagctcgtctggagccgcataggcgccgaagccgcccaccccaagggtcatgttatcttgaatcagagcagccgcttcctcggctgtgatccgctgcgccacatcacatcatcctttctgtgttccgcgccccgcttaccgagcggggccttcgcccatggaatcagcaagaggcatgccaatatggaagaatccattataagcggtgcgggagacagggggcggcccctccggccgctgccgcatacagaggcgctcattgcgcataaatgcctgttttttgcgcccggtgcccgtcacaaaagcgcctattcgttgcagcgcaacgaataggcgcttttgcgcaatatgaaacctaaaaatgcgcataagtgcatgtttttgatggaggatgccccggctaaatacgcatttttctcaaaaaacaggcaaaatggggcgaaaaatgctgaatggaggagttggccctgcgtttgctttaagaacagaatgtctccggcggttttacccttcacgccggggcaaacgaacgtcatcctatgacgagaacgtgtagaggagcgatattatggcgaggagaaaagtgattatcacggtggcccagacgggcgcgttccacggcaaggaggcaaatcccaatatccccctgaccccggaggagattgcggcctccgcgtacgactgctacaatgcaggtgcggccattatccacattcacgcccgggatcaagagggcttgtccaccaatgatcccaaggtatacagcgccatcggctcgggcatccgggccaggtgtaatgccattcttcagtactctaccgcccccgcaaaccgggagggaacctgcgctgaggacggcatgaggctgctgtacgaccccgacctggtcaagcctgagatgtgctccctggactgctccctgatcggcacgagctggggggaccgtacctttgtctacgagtggtaccgccccttcctgctcaagtacgcccggaaaatgcgggacatgggcatcaagccggagctggagtgcttcaaccccgagagcgtggaggacgtgttcaatgtactggtaccagccggcgtgctggaggagcccgtctcactctcctttgtcatgggtatggaccgcatcagccagggctccatctccttctccgaggagaacctggacttcatgatcaagaagctgcctaaggaccgctttgtgaacttttccaccatctccatcggtgccaaacatcacgttcccggcatggcgatgaccgtcctcaagggcggcggggcccgggtgggtatggaagacaacatctactacgcccccggagagctgctcaagagcaacgcccaaatggtggagcgggccgtgcgcatcatccgcgagctgggcatggaggtcgccacccccgacgaggcccgcgaaattctgaagctcggccggtaagcccaatctgacggagaggaagagacgaatggaaaagcagaaattctatatgccggcctccctgttgatcaaaattctggtctgcctggcggtcatcgccgccttctgggtggctccgccggtggcgcccctgaccgccgtcggtatgcgggtcatcggtatcttcatcggcgttatcctgatgctgtccattgtggatacggtgtggccggctatgctggccatcgtgctgctgggacagagcggcgtatgcaccgtcaatgaagccatcgcgggctccatcggcaactggatcatctattttgtgctgatgagctttatcatgacccatgccctcaacgagtccggttttaccgaccggctggtagccaaatttatgagcatcaagctggtcagcaaaagcccctggatctttaccatttccctgggtgtgctcggcatgctcctggggtgctttatggatcaggtgcccgccaccgcctttatgctggcgtttgtctcccgcatctacaaagagctgggctacaccagtcgggatgcctatccccatgtggccaacatcctcacagtgttcggcgtcaacatcggcggagccatgacccccatctcccactccttggccattctgggcatcggcatttatgagggggccacaggggagagcctgagtctgttcagctatctggccttcggcgtgcccacgggcctgatcctgttcgttctgctgtgcgtcgcggtgcgcctgctgacccgtccggatatgtccaaattcaaggacttcaagattgagaacgtcgtcaaaaagcagggccccatgacgctgcgggagggtaccactgcagtggtattctttgtgaccgttatcatgtggattctgcccggagtgcttaagatgttcagcgataccgcttgggtcaatgctttcaacagtttcggcattaccttctgggcgatcctatccgtggtggtaatggcggtgatccacattgacggcaggcccctgctggacgtcaggactgtggtcaaccagagcatcaactggggcatcctgattttcatcagcatcggtgtctacctgggcagcgccatgagcgccgattccaccggaatcgtggccgccattcagcagaatattacccccctcacccaaagcgtggcgcctgtggtggtggtgtttgtcatcgccactgtctccgtcctgatgaccaactttgcttccaacgtgtccactatcacggtaatgacagcggtgggtgtggctctggcagccagcagcggcggagccatcagcgcggtgggcattgccctggtgacaacgatgtgcggctcatgcgcctatttgctgccctcctccttcgccaccattgccatgctccacggacacgagtacagcagccgtaaccagatatatctgttcggcattatcatgattgtaattacatctctgatcattggattcgtaggatatcccatcggctgtgcgctgactgggagctgagcctctgtcatctgtgctctgaagacataagctggaatgtagtccccggattgaaagcaacccttcaacagggccgccggtgtttcaaagaaccggcggcccctttctatcccgtgacaaaaagggaataccctcagatggggaagcggtcaatttattgcacgaaccaagtactgtcatatcaaaggcggacatacagaggacactctataaactggagcacaacacatttcggcggctatggatgagtctgcgctgtttcgagatgcggtattatggataacgcaaaaaagatgctcatcatgcgccacgggtttaaaagcattacctttagcgcatataaggagcggctgctaaagctgttccggatggctgccgaccgcccccaactggtggacggccggtggtacaaccagcagatacagtacactcaaaacgacgtgagtatcatcatcataagttcgcgcatcaccgtctccaaaccgctcaataagtcatgtgaggaggggataatccgtatgctgaaccgcagaatccagattgacgtgcacctcaagccagaggagctgtgatttatgttacttgatatatacggcagggcaagtctacattgtaaaaaaggctctgataggatcggctgcatccgccggcggtcccgcatggttcgaagacccaaggtttaaatctcctctctgcggcataaaacccgtcggaatccttggattccgacgggttttatgctgcccgctgccagagtgcctggagaggatatccctgccgggcatcgactggaaacaatgtgctaaaccatattgaggtaattgtagatggcagtcatgaaaattgcgtcccgaatgctggtcagggggctgatgcccagcagctctttgattttcttgacccgggctgccacagtgttcttgtggagatagagcagctccgccgcctcgctcaggttcatactggtttcgatcagcgcaccgatggtctcacgaaagatggactcatccatatgctcccggatcaggcgtacatagatgtccaacagaggggccatggtctcggtggagatctggctcatcatgtattcggtcaggtagtcggctagaaagtacaccttaagctctttcttctggcggtagcggtacagccacatgatatcctcatagatgcggccgtaataggaaaagcggttctggaccgtgccgcagatatagcggcttttctgtccgggcacctgagattcaaaccatgcatcgatttcttcgatacacaggcggatctggttgcggtaggtggccaccgtagtttcgtcaatctgcttgaagagcaggagcaggttgccgccgatacagaacagcaggtcgttgggagaatggctgggggaattcgggtagtcctcggcaaagcgggaaagcaccagttcggagctctcgcaccccacatactcaataagaaggggatagcggttgacgtgctcagtgatacccagttcagcggcctgggagcggatgcgcatgatgttgaccgggcggtccacaaagagaaggcgggccagatggctcatggcgccggtggaggcagtggggaggaattcacgctggagttcgtagtcgtacagcgattcaaacgacagcttgatgagcttggccagggacattacggtggatggatcgccggagacgccgatgacgcccaccgggatcaggttctcccgcagcagcaggttcaccccaggcgaagtcacgccggggagatcctcggtcagatcctcggtgacgttgatgctgatgttgttggtgatcatgcggaaggcggtagcgtggaaggtgcccacacgctcttcactgcacgacgcaatgatgataccgtgctcattcatgatgttgatgttgtagtcggtctgggagcggatgcgtcggataaactgctcagcaaaggcctggttgatcatgggcggcacctccctttttgccctttattgtaccatagctgggcagaaagcacaactgattgggtatccgggcatgtgaaaaggcgcctgaaagggcgccttttcacatagaggtttagtctaggcgggcgccgttttcgttcatacgggcgcggatttcagcgccggacagctcacgcaggggcagatcccgccggatggacaggtcggctgccagcgcggcagcgtgtccatattcaaagcactgggcggtgacccggcagcttgccagggcctggtgctcggcgcacaggttgcgcccggccacaagcagatgctcgccggtttccggaaccagggagccgtagggaacctcgtagtaatcgttgatgagccagaacaggtagggcgtttcaccggcgtggagttcaatgggccaggggcagcgacagatgccgtcggagcgcttgcgggcatgggccacgtcgtcattggtgagccgcgcaatgccgcggatgctgcgggtttggcggacgcccacttcgggagagcagtcgttgataaagctgtgctcacagccgggaatatgctcccggaagaagcgggcgtattcctgtacctggcggcggccgacgatctccgcctcagtgtggtcctccgggttgcatacgttcagcgcccgaccgtcccggccggtcagtagggtagtgttcatcagcagttcaccgggccggggagtaggaaagacccagaccttggcccggggcagatgccagccctggcggttggcctcgtggagcagctccgtcacacagtcgggactgatagtgtccggcccccagtagtcggagaagcgcgccgtgtccaccccgcccaagcggaacatggcggtgggattctggatggtgccgttgtcccccatggtgtagccgccgcccgccctgtagaccagatccgcgtcgccggtggcgtctatgagcaccttggcgcggatctgggccaggccgctcttggtatcaattaccaccccataaaaaatatccccctccttgatgacgccgaaaatattggtatgatagaggatgcccgcccctgcgcccagcaccagctcctcggccacttctttatagacctggggatcgtgggtgatgagataggtcttgccgtagagctgcgggggcgtcacgccgccccgggcgcgcatggcctggagaaactcctctgtaaagccgaagacggtctggcgggggccgtcggcttccggcgtgtcactgcacagaaatgtaccgcagaccgtgccggaaccaccggccactgccgcgccccccagaaaacccagccgctccaccagaaggacggagcgcccctgccgggcggccatggaggccgccgcaatgccggccggcccaccgccgcagactaggacgtccacctcgtcatacagtgggagcgcacagtcggtgtggtagataacggtatggcgaaattctttcaattgcttcacctcatgttctgcgccggtcggggcgctctatgttgtatatccagtatgacagatctgaccgctgggcggaatgtgccgctgacacagctttgcaaagcttttctatggagctggaacaaggcgggagacagtcgctgcggcgggctgatataaatcagtgccgcagtcattcttttggcacaaaactttgtgaccgcgacacattaggcagggtggggggccgtgctatacttgaggtatgcagaggcgagataacggccgtcaggccgtgccgacaagcaaggaggaattgctgccatgtggaagtattacaacccggtggaagtggtcttcggcaccgggaagctggatgagctgggacagcttatggccgagcgggggctggaccgggcgctgatcgtctccgatcccttcacccaccgcagcggcgtggccgcgcggctgaaggagtgcgcgggcggccgcgtgctggacatcatctctgaggtggagcccaatcccacctgtgacaacgtggacgcctgcgcccggcgggccagggagctgggggcccggtccatcatcggcctgggcggcggctccgccatggactgcgccaaggccgcggcggctgcggccgccatggactgcaccggcctggagctgctgcgggggaggcccgtcaccgatgcgctgcccctcattgccgtgccaaccaccgccggaaccggcagcgaggtgggctggggcgcggtgctctccgaccacgccgccaacgccaaaatcgccattttcggcagtcccatgttccccaggctggccctggtggacccggtgctgacctacactgtgccccccgccgtcaccgcctccaccggcctggacgtgatcgcccacagcctggacgccatgtgctcggtccgggccaacccggtgtccgacggcctggccgtccgggccgccaagctggcctttgagaacctggaggccgccttccgggacggctccgacgccgtggcgcgggagcggatggccatggccagcaccatcgccggttatgccttcagcaatacgggcaccaccggcagccacgcctgctcctacctgctgaccgccaagtaccatatcccccatggcgaggcctgcgccctcaccctggatgcctggttccggaaggacgcagcggtgcgcccgctgctccacaccctcagccgcatgatgggcttcgccgacgccaacgcggccgccgaccggttggccgagctgaaggagctcaccggcatgcgcaccaccctgaccgccatgggcgtgcccgatacgcaggaggccctcgacgagctggcggccaacgccgccgcgtcgggcaacatggcaaacgacatctgcaaggccacaagggaggacatcgcgtccctttttgcgtccctgcgctgagaaaaggaggaacggatatggacaacctgacgccgtggaaagaggcgctgaaggaacggacgctgtacggctgctttgtgacctacggcctgccggacatcgcggaggtcacggccctgatgggctttgatttcctgctgctggacaacgagcacggggtgatcgagcagagcaccctggcggacatggtgcgggcctcccagctgcggggggtgcccgcggtggtgcggtgcaccatgaaggagtacgaccacatccagaaggccctggacttcggcgccaacggcgtgcagctccccctggtgaacaccgccgaggacgcccggcgggtggtggagctggccaactacgccccccaggggcgccggggcaccgcctacctcccccgcgccgcccggtacggcatggtggaggacaagcgggcctacctgaggcaggccaacgacaccaagctggtgtgctgccaggtggagacccgccaggcagtggagaacctggatgggattctggaggtggacggggtggacgtctacttcatcggccccggcgacctggccgcctcctacggggagcccgccggcagccccaaaatgctggagctgaccgagcggatgatccgccgtatcgtggccgcgggaaagaccgccggctactacgtgggcacgcctgaggcggccagacaggccgaggagtggggggcccgctatctggtcaccgcggtcaaccagtacatggtgtccggcggcaggagcttcctgagccaggtacgcgggggcggggcggtggccgcctcctccgcgtactgaggaggcccccatggaggacatgcacctgattctccgctggcacggggagaaggaccccatctccctgcgccagtacgcgcagattcccaacctgtacggcattgtcacctccctctatcatctgcccctggggcaggtgtgggaccgggcggaggtgctgcgcctgaaggagcagatcgaggcccacggcctgaagtttgagcttgtggacagcttccgcattcacgaggacatcaagcggggctatgcctccagggacgccctcatcgaaaactaccggaaaaacatccgcatgctggcggagtgcggcatccggatcatctgctacaacttcatgccggtctttgactggacccgtaccgatctggcccatgtcctccccgacggctcggactgcctgagctttgaggaggaaaaggtgcgggccgtggacccggagaggggcattgagctgcccggctgggggaccaaccacactccggcggagctccaggccctgctgcacagctaccggggcatcggggaggaggagctgtgggacaactgccgctatttcctccgggcggtgctcccggtggcggaggagtgcggcgtcaagctggccctccaccccgacgacccgccgcggcccatcttcggcctgccgcgcatcgccaagaacgccgcggactaccggcgcatcctcttcacccccgacctggacagccccagcaacaccatcaccttctgctgcggctccctgggctccggcgcggacaacgatctgcccgccatgatccgggaattcggttccagggggaagctcccctttgtccacttccgcaacgtccagctggagcccagcggcgacttttacgagtccggccatcagaccggctgcggcagcagtgacatgggggaggtcatgcgggctctgtgcgatatggatcagcccttctatttgcgccctgaccacggccggcgtatctgggatgaggcgtggagcattagagaggtgacggacgccgacggtacccagcgggtagagcatcggccggacggctggaacggcgtcaagcctgcggcgggctacggcctgtttgaccgcgccctgggggcggcctacgcccaggggctctatgagggcatccgcagggagcgggccgcccaattgacaaaggagtgagtacattgcgtaaagtgatttcccggcaggaggccgcagccctggtgcaggacggaatgacgctgggcatgctgggcttcgtgaccctgtcggttccggaggagctgctggtctccctggaggagcgctttctggccgagggccacccaagggatctgaacgtgttctacacctccgccatcggagacggcggggaacatggcgccaaccacctggcccacgcggggctggtgcggcgtatggtgggcgcccatgtaggtctggctcccaagctcaaccctctgatcacgggcaaccagatcgagaccttttgcgcccctcagggggtgctggttcatatgtgccgggccatggcggggcacaagtgcggcgtcattacccacgtgggcctcaagaccttctgcgacccggaggtggaggcatgctgcttcaacgacgcggccaggaaagcccacactgagggccggggcatcgtccagagcattgagatcgacggccgccggctgctccactacaagctgacgccccccgacgtgtgcttcatcaaggccacctacggcgacagccggggcaatctgtccatggagaaggaagggctgtttctggagcagttagagatggcccttgctaccaagaacaacggcggaaccgtcatcgcccaggtggataccctggtggaggacaacaccctggacccccgcagcgtgaaggtccacggctgcttcgtggactatgtggtggtggggcggccggagtacagccgccagcactacttcgacgccatcccctaccatccggagtggaccggcgaggtcagggtgcccatgggtgccctggagccaatggagctgggcatccgcaagattatcgcccgacggggcgccatggagctgcggagggagtgcctggtaaacctgggcttcggcatgcccgacggtgtggcctccgtggccggcgaggagggggtggccggcgagatgaccctgtccatcgagtcgggcacactgggcggcgtgccagcccccggcaacggctgcggcgcctccgccgacgtggaggccattgtcaagcacaccgagattttcgacggctatgacggtggcagcatcgacatcgcctatctgggcgcggcccagatcgaccgccacggcaatgtaaacgtgtccaagttcgccgggcggatgaccggccccggcggcttcatcaacatcacgcagaacgccaagaaaatctgctttatgggcaccttctcctcggtgaaggacaccgatatccgcctggaaaacggacggctgaacatcgtcaaggactccaatgtggtcaagtttgtcccggaggtagagcagatcaccttctccggcgattacgcgcgggagaccggccaggaggtgctctacattacggcgcgggcggtattccgcctgaccgaccaaggcctgaccctcgtggaggtggcccccggcgcggagctggagcgggacatctatccactgatgggcttccggcctgctgtggctgccgatctgaaagagatggatccgcgaatttttcgcccggaaaaaatggggcttgtgctccaggattgagagggaaaacacgatgaacagctttactctggatgaaatctatgtggggcagaaggcgtcggtcaccaagaccatcaccaggggcgacatctacgcctttgccggcctggtggacgactacagccccgtccacatcgacaaggcgttcggcgagcagagccccttcggccggtgcatcgcccacggcttcctgtccggcgccctgttcagcaccctggcgggcaattacctgccaggcgcaggcagcctctatgtgcgccagagcctgaactttctcaggccggtctacgcgggggacaccatcaccgccacctttgaggtggtcaaaaagggcgaggaggtcaccaaacccgacggcacggtaaagttcagccccggccgcatcgttatgaaggccaccgccgtcaatcagaggggcgaggtggtggtggagggcgaggcatgctctatggctgcccgggaaaaggtggattgcagccggttctgaatccgggggactagcgcaatagtgcccaaagaggtgcgcgcccttatgtgctgtatttgtggaaatgtattaaagacataagatagcgcctgattcttgtgttgccgtcacagtgcacatacggtgtgcccgtgtataataaagttatccggatgagacagcaactgtggaacgacaaacagagaaatgagggatcaaagcaatgttcttgaaaaagttcggggatctggctgcgggcgtattcttcctgattctttccatcgccctcttcctggcggccagcgcactgccgcccagcctgatggggggacttggctccgacttcatgccgaaggttctggccatcattacctgcatcctctccttctttcaaatccgtgccggattccgcaccatgcgaagcttccagccgaatgaaggagcggaggaggagaagccggagtacctgcgggtgctggccaccatcgcggcattcaccgtatatgtgtttgtcattgagccggcgggcttcctcctcagctccatcgtgtatctgtttgcacagatcactatcctggcgcccaaagagaagcggggcatcaaagggatcatcctgttcgcggtgatcgccgtcgtggtgtgcgtcgcggtttactttatcttccggttcggtctgaatgtcatgctgcccgccggcatactgggttaaaaggaggcgcaactgatggaaaccttatccctgattggaaacgcatttgccgggatgatgaaccccatgtccattctgctgctgatcgtcggtgtcgcggtgggcattgtgttcggctccatcccaggcctgtccgccgccatggcggtggccctcttcctgccggtcaccttcgccatgcaggcccatgaggcgttcaccctactcgtggcgctctacatcggcgggatctccggcggcctgatctctgccatcctcatcaacatccccggcacctcctcctccatcgccacctgcttcgatggctcccccatggccaaaaagggtgaggcgggcaaggctctgggtaccggagtggtattctccttcctgggcggcctgttctccttcctggtgcttatgttcgtggccccttccgtggcgcagattaccctgaagttttccgccatcgagtacttcggcgtgtgcctctttgccctctctatgatcgccgccctggcgggcaccagcatgatcaagggactgctctccggctgcctgggcctgatcattgccttggtgggtatggcgcccattgatggaaccaagcgattcaccttcggtatcaacgaactgtcctccggctttgacatcctgcctaccctgatcggcatctttgccattgcggaggtgctggcctacgctgaagaggtcaaaaagatgggaaaggccactcagatcaagcagagctttaaaatcaagggcttcggattcacctggaaggagttcgtggggcagaagtggaacgcactgcgctccgccctcatcggtaccggcatcggtatcctgcccggcatcgg
